(12) United States Patent
Sanz Molinero et al.

(10) Patent No.: US 9,175,303 B2
(45) Date of Patent: Nov. 3, 2015

(54) PLANTS HAVING ENHANCED YIELD-RELATED TRAITS AND A METHOD FOR MAKING THE SAME

(75) Inventors: Ana Isabel Sanz Molinero, Gentbrugge (BE); Yves Hatzfeld, Lille (FR); Christophe Reuzeau, Tocan Saint Apre (FR)

(73) Assignee: BASF Plant Science GmbH, Ludwigshafen (DE)

( * ) Notice: Subject to any disclaimer, the term of this patent is extended or adjusted under 35 U.S.C. 154(b) by 419 days.

(21) Appl. No.: 13/003,902

(22) PCT Filed: Jul. 14, 2009

(86) PCT No.: PCT/EP2009/058942
§ 371 (c)(1),
(2), (4) Date: Jan. 13, 2011

(87) PCT Pub. No.: WO2010/007035
PCT Pub. Date: Jan. 21, 2010

(65) Prior Publication Data
US 2011/0131684 A1    Jun. 2, 2011

Related U.S. Application Data

(60) Provisional application No. 61/081,823, filed on Jul. 18, 2008, provisional application No. 61/082,239, filed on Jul. 21, 2008, provisional application No. 61/084,641, filed on Jul. 30, 2008, provisional application No. 61/089,927, filed on Aug. 19, 2008, provisional application No. 61/119,809, filed on Dec. 4, 2008.

(30) Foreign Application Priority Data

| Jul. 17, 2008 | (EP) | 08160636 |
| Jul. 18, 2008 | (EP) | 08160752 |
| Jul. 30, 2008 | (EP) | 08161407 |
| Aug. 19, 2008 | (EP) | 08162611 |
| Nov. 24, 2008 | (EP) | 08169818 |

(51) Int. Cl.
*C12N 15/82* (2006.01)
*C12N 9/04* (2006.01)
*C12N 9/88* (2006.01)

(52) U.S. Cl.
CPC .......... *C12N 15/8261* (2013.01); *C12N 9/0006* (2013.01); *C12N 9/88* (2013.01)

(58) Field of Classification Search
None
See application file for complete search history.

(56) References Cited

U.S. PATENT DOCUMENTS

| 2002/0152497 A1* | 10/2002 | Falco et al. ................... 800/278 |
| 2004/0123343 A1 | 6/2004 | La Rosa et al. |
| 2004/0172684 A1 | 9/2004 | Kovalic et al. |
| 2006/0037106 A1* | 2/2006 | Mironov ....................... 800/287 |

FOREIGN PATENT DOCUMENTS

| WO | WO-03/000906 A2 | 1/2003 |
| WO | WO-03/008540 A2 | 1/2003 |
| WO | WO-2004/070027 A2 | 8/2004 |

OTHER PUBLICATIONS

Vieira Dos Santos et al. 2005. The Arabidopsis plastidic methionine sulfoxide reductase B proteins. Sequence and activity characteristics, comparison of the expression with plastidic methionine sulfoxide reductase A, and induction by photooxidative stress. Plant Phys. 138:909-922.*
Weissbach et al. 2002. Peptide methionine sulfoxide reductase: Structure, mechanism of action, and biological function. Arch. Biochem. Biophys. 397(2):172-178.*
Guo et al. 2004. Protein tolerance to random amino acid change. PNAS. 101(25):9205-9210.*
de Pater et al. The promoter of the rice gene GOS2 is active in various different monocot tissues and binds rice nuclear factor ASF-1. Plant J. Nov. 1992;2(6):837-44.*
Adams, M. J., et al., "The Three Dimensional Structure of Sheep Liver 6-Phosphogluconate Dehydrogenase at 2.6 Å Resolution," The EMBO Journal, 1983, vol. 2, No. 6, pp. 1009-1014.
Altschul, S. F., et al., "Basic Local Alignment Search Tool," J. Mol. Biol., 1990, vol. 215, pp. 403-410.
Attwood, T. K., et al., "PRINTS and its Automatic Supplement, prePRINTS," Nucleic Acids Research, 2003, vol. 31, No. 1, pp. 400-402.
Bechtold, U., et al., "Arabidopsis Peptide Methionine, Sulfoxide Reductase2 Prevents Cellular Oxidative Damage in Long Nights," The Plant Cell, 2004, vol. 16, pp. 908-919.
Boschi-Muller, S., et al., "The enzymology and Biochemistry of Methionine Sulfoxide Reductases," Biochimica et Biophysica Acta, 2005, vol. 1703, pp. 231-238.
Boschi-Muller, S., et al., "The Methionine Sulfoxide Reductases: Catalysis and Substrate Specificities," Archives of Biochemistry and Biophysics, 2008, vol. 474, pp. 266-273.
Botstein, D., et al., "Construction of a Genetic Linkage Map in Man Using Restriction Fragment Length Polymorphisms," Am. J. Hum. Genet., 1980, vol. 32, pp. 314-331.

(Continued)

*Primary Examiner* — Cynthia Collins
(74) *Attorney, Agent, or Firm* — Drinker Biddle & Reath LLP

(57) ABSTRACT

The present invention relates generally to the field of molecular biology and concerns a method for enhancing yield-related traits by modulating expression in a plant of a nucleic acid encoding an MSR (Methionine_Sulfoxide_Reductase), a nucleic acid encoding an Enolase, or a nucleic acid encoding a ZAT-like zinc transporter. The present invention further concerns a method for improving various plant growth characteristics by modulating expression in a plant of a nucleic acid encoding 6-PGDH (6-phosphogluconate dehydrogenase or 6-phosphogluconate dehydrogenase) polypeptide. Plants having modulated expression of a nucleic acid encoding a MSR, an Enolase, a ZAT-like zinc transporter, or 6-PGDH polypeptide and enhanced yield-related traits or improved growth characteristics relative to corresponding wild type or control plants are also provided. Further provided are constructs useful in the methods of the invention.

21 Claims, 39 Drawing Sheets

(56) References Cited

OTHER PUBLICATIONS

Broedel, S. E., et al., "Genetic Tagging, Cloning, and DNA Sequence of the *Synechococcus* sp. Strain PCC 7942 Gene (*gnd*) Encoding 6-Phosphogluconate Dehydrogenase," Journal of Bacteriology, 1990, vol. 172, No. 7, pp. 4023-4031.

Brot, N., et al., "Reduction of N-Acetyl Methionine Sulfoxide: A Simple Assay for Peptide Methionine Sulfoxide Reductase," Analytical Biochemistry, 1982, vol. 122, pp. 291-294.

Eigenbrodt, E., et al., "Influence of Transformation by Rous sarcoma Virus on the Amount, Phosphorylation and Enzyme Kinetic Properties of Enolase," The EMBO Journal, 1983, vol. 2, No. 9, pp. 1565-1570.

El Hassouni, M., et al., "The Minimal Gene Set Member msrA, Encoding Peptide Methionine Sulfoxide Reductase, Is a Virulence Determinant of the Plant Pathogen *Erwinia chrysanthemi*," Proc. Natl. Acad. Sci. USA, 1999, vol. 96, pp. 887-892.

Fleischmann, A., et al., "IntEnz, the Integrated Relational Enzyme Database," Nucleic Acids Research, 2004, vol. 32, pp. D434-D437.

Forsthoefel, N. R., et al., "Posttranscriptional and Posttranslational Control of Enolase Expression in the Facultative Crassulacean Acid Metabolism Plant *Mesembryanthemum crystallinum* L," Plant Physiol., 1995, vol. 108, pp. 1185-1195.

Giegé, P., et al., "Enzymes of Glycolysis are Functionally Associated with the Mitochondrion in Arabidopsis Cells," The Plant Cell, 2003, vol. 15, pp. 2140-2151.

Huang, J., et al., "Molecular Cloning and Characterization of Rice 6-Phosphogluconate Dehydrogenase Gene that Is Up-Regulated by Salt Stress," Molecular Biology Reports, 2003, vol. 30, pp. 223-227.

Krepinsky, K., et al., "Purification and Cloning of Chloroplast 6-Phosphogluconate Dehydrogenase from Spinach. Cyanobacterial Genes for Chloroplast and Cytosolic Isoenzymes Encoded in Eukaryotic Chromosomes," Eur. J. Biochem., 2001, vol. 268, pp. 2678-2686.

Kryukov, G. V., et al., "Selenoprotein R Is a Zinc-Containing Stereo-Specific Methionine Sulfoxide Reductase," PNAS, 2002, vol. 99, No. 7, pp. 4245-4250.

Lal, S. K., et al., "Characterization of a Maize cDNA that Complements an Enolase-Deficient Mutant of *Escherichia coli*," Plant Molecular Biology, 1991, vol. 16, pp. 787-795.

Lal, S. K., et al., "Differential Regulation of Enolase during Anaerobiosis in Maize," Plant Physiol., 1998, vol. 118, pp. 1285-1293.

Lee, H., et al., "LOS2, a Genetic Locus Required for Cold-Responsive Gene Transcription Encodes a Bi-Functional Enolase," The EMBO Journal, 2002, vol. 21, No. 11, pp. 2692-2702.

Ramesh, S. A., et al., "Over-Expression of an *Arabidopsis* Zinc Transporter in *Hordeum vulgare* Increases Short-Term Zinc Uptake after Zinc Deprivation and Seed Zinc Content," Plant Molecular Biology, 2004, vol. 54, pp. 373-385.

Rouhier, N., et al., "Plant Methionine Sulfoxide Reductase A and B Multigenic Families," Photosynth. Res., 2006, vol. 89, pp. 247-262.

Sadanandom, A., et al., "Differential Regulation of Plastidial and Cytosolic Isoforms of Peptide Methionine Sulfoxide Reductase in Arabidopsis," Plant Physiology, 2000, vol. 123, pp. 255-263.

Sanchez, J., et al., "Reduction of N-Acetyl Methionine Sulfoxide in Plants," Plant Physiol., 1983, vol. 73, pp. 619-623.

Subramanian, A., et al., "Structural Analysis of α-Enolase. Mapping the Functional Domains Involved in Down-Regulation of the c-myc Protooncogene," The Journal of Biological Chemistry, 2000, vol. 275, No. 8, pp. 5958-5965.

Sundaramoorthy, R., et al., "Crystal Structures of a Bacterial 6-Phosphogluconate Dehydrogenase Reveal Aspects of Specificity, Mechanism and Mode of Inhibition by Analogues of High-Energy Reaction Intermediates," FEBS Journal, 2007, vol. 274, pp. 275-286.

Van Der Straeten, D., et al., "Plant Enolase: Gene Structure, Expression, and Evolution," The Plant Cell, 1991, vol. 3, pp. 719-735.

Van Der Zaal, B. J., et al., "Overexpression of a Novel Arabidopsis Gene Related to Putative Zinc-Transporter Genes from Animals Can Lead to Enhanced Zinc Resistance and Accumulation," Plant Physiology, 1999, vol. 119, pp. 1047-1055.

Vieira Dos Santos, C., et al., "The Arabidopsis Plastidic Methionine Sulfoxide Reductase B Proteins. Sequence and Activity Characteristics, Comparison of the Expression with Plastidic Methionine Sulfoxide Reductase A, and Induction by Photooxidative Stress," Plant Physiology, 2005, vol. 138, pp. 909-922.

Fitch, W. M., "Homology—A Personal View on Some of the Problems," Trends in Genetics, 2000, vol. 16, No. 5, pp. 227-231.

Romero, H. M., et al., "Investigations into the Role of the Plastidial Peptide Methionine Sulfoxide Reductase in Response to Oxidative Stress in Arabidopsis", Plant Physiol., 2004, vol. 136, No. 3, pp. 3784-3794.

Office Communication with Extended European Search Report Issued by European Patent Office in European Application No. 13170017.1 dated Jan. 2, 2014.

* cited by examiner

```
                                          1                                             45
        PF61417_100__Zea    (1) ---------------------------------------------
        PF61417_54__Oryza   (1) ---------------------------------------------
   PF61417_6__Arabidopsis   (1) ---------------------------------------------
       PF61417_82__Populus  (1) ---------------------------------------------
 PF61417_72__Physcomitrella (1) ---------------------------------------------
   PF61417_24__Arabidopsis  (1) ---------------------------------------------
   PF61417_28__Arabidopsis  (1) ---------------------------------------------
   PF61417_30__Arabidopsis  (1) ---------------------------------------------
       PF61417_32__Glycine  (1) ---------------------------------------------
       PF61417_34__Glycine  (1) ---------------------------------------------
        PF61417_42__linum   (1) ---------------------------------------------
       PF61417_80__Populus  (1) ---------------------------------------------
       PF61417_92__Populus  (1) ---------------------------------------------
        PF61417_58__Oryza   (1) ---------------------------------------------
      PF61417_98__Triticum  (1) ---------------------------------------------
      PF61417_46__Medicago  (1) ---------------------------------------------
       PF61417_88__Populus  (1) ---------------------------------------------
       PF61417_90__Populus  (1) ---------------------------------------------
       PF61417_40__Hordeum  (1) ---------------------------------------------
      PF61417_94__Triticum  (1) ---------------------------------------------
      PF61417_44__Medicago  (1) ---------------------------------------------
      PF61417_96__Triticum  (1) ---------------------------------------------
        PF61417_50__Oryza   (1) ---------------------------------------------
 PF61417_64__Physcomitrella (1) ---------------------------------------------
   PF61417_26__Arabidopsis  (1) ---------------------------------------------
 PF61417_66__Physcomitrella (1) ---------------------------------------------
 PF61417_68__Physcomitrella (1) ---------------------------------------------
 PF61417_70__Physcomitrella (1) ---------------------------------------------
  PF61417_60__Ostreococcus  (1) ---------------------------------------------
       PF61417_36__Hordeum  (1) ---------------------------------------------
       PF61417_38__Hordeum  (1) ---------------------------------------------
  PF61417_62__Ostreococcus  (1) ---------------------------------------------
       PF61417_76__Populus  (1) ---------------------------------------------
       PF61417_78__Populus  (1) ---------------------------------------------
     PF61417_134__Medicago  (1) ---------------------------------------------
      PF61417_124__Glycine  (1) ---------------------------------------------
      PF61417_144__Solanum  (1) ---------------------------------------------
      PF61417_146__Solanum  (1) ---------------------------------------------
       PF61417_86__Populus  (1) ---------------------------------------------
     PF61417_114__Brassica  (1) ---------------------------------------------
    PF61417_4__Arabidopsis  (1) ---------------------------------------------
      PF61417_128__Hordeum  (1) ---------------------------------------------
      PF61417_130__Hordeum  (1) ---------------------------------------------
```

FIGURE 1

| | |
|---|---|
| PF61417_156__Triticum | (1) ------------------------------------------------ |
| PF61417_164__Triticum | (1) ------------------------------------------------ |
| PF61417_56__Oryza | (1) ------------------------------------------------ |
| PF61417_166__Zea | (1) ------------------------------------------------ |
| PF61417_170__Zea | (1) ------------------------------------------------ |
| PF61417_168__Zea | (1) ------------------------------------------------ |
| PF61417_136__Physcomitrella | (1) ------------------------------------------------ |
| PF61417_74__Populus | (1) ------------------------------------------------ |
| PF61417_104__Arabidopsis | (1) ------------------------------------------------ |
| PF61417_20__Arabidopsis | (1) ------------------------------------------------ |
| PF61417_110__Brassica | (1) ------------------------------------------------ |
| PF61417_16__Arabidopsis | (1) ------------------------------------------------ |
| PF61417_18__Arabidopsis | (1) ------------------------------------------------ |
| PF61417_14__Arabidopsis | (1) ------------------------------------------------ |
| PF61417_106__Arabidopsis | (1) ------------------------------------------------ |
| PF61417_22__Arabidopsis | (1) ------------------------------------------------ |
| PF61417_108__Brassica | (1) ------------------------------------------------ |
| PF61417_112__Brassica | (1) ------------------------------------------------ |
| PF61417_10__Arabidopsis | (1) ------------------------------------------------ |
| PF61417_116__Brassica | (1) ------------------------------------------------ |
| PF61417_12__Arabidopsis | (1) ------------------------------------------------ |
| PF61417_8__Arabidopsis | (1) ------------------------------------------------ |
| PF61417_118__Glycine | (1) ------------------------------------------------ |
| PF61417_122__Glycine | (1) ------------------------------------------------ |
| PF61417_126__Glycine | (1) ------------------------------------------------ |
| PF61417_132__Medicago | (1) ------------------------------------------------ |
| PF61417_152__Solanum | (1) ------------------------------------------------ |
| PF61417_84__Populus | (1) ------------------------------------------------ |
| PF61417_150__Solanum | (1) ------------------------------------------------ |
| PF61417_154__Triticum | (1) ------------------------------------------------ |
| PF61417_162__Triticum | (1) ------------------------------------------------ |
| PF61417_160__Triticum | (1) ------------------------------------------------ |
| PF61417_52__Oryza | (1) ------------------------------------------------ |
| PF61417_142__Solanum | (1) ------------------------------------------------ |
| PF61417_148__Solanum | (1) ------------------------------------------------ |
| PF61417_120__Glycine | (1) MNDLFSGSFSRFRSDQSSPDRHHDIEMGATASSGGRGGEVNLDKF |
| PF61417_172__Zea | (1) ------------------------------------------------ |
| PF61417_158__Triticum | (1) ------------------------------------------------ |
| PF61417_48__Oryza | (1) ------------------------------------------------ |
| PF61417_138__Physcomitrella | (1) ------------------------------------------------ |
| PF61417_140__Physcomitrella | (1) ------------------------------------------------ |
| PF61417_2__Oryza | (1) ------------------------------------------------ |
| PF61417_102__Medicago | (1) ------------------------------------------------ |
| Consensus | (1) |

FIGURE 1 (continued)

```
                                    46                                          90
         PF61417_100__Zea     (1) ---------------------------------------------
         PF61417_54__Oryza    (1) ---------------------------------------------
      PF61417_6__Arabidopsis  (1) ---------------------------------------------
         PF61417_82__Populus  (1) ---------------------------------------------
    PF61417_72__Physcomitrella(1) ---------------------------------------------
      PF61417_24__Arabidopsis (1) ----------------------MQVLVVSPPLIAAASLSKPL
      PF61417_28__Arabidopsis (1) ---------------------------------------------
      PF61417_30__Arabidopsis (1) ---------------------------------------------
         PF61417_32__Glycine  (1) ---------------------------------------------
         PF61417_34__Glycine  (1) ----------------MRICGAAISSSYTTTSNSLLVFASSSLSS
         PF61417_42__linum    (1) ---------------------------------------------
         PF61417_80__Populus  (1) ----------------MLQTLSTHLSSTS--TSTSTTTPLLLL
         PF61417_92__Populus  (1) ----------------MLRNLATHFSSTSSTTTSSSTTPLLVL
         PF61417_58__Oryza    (1) ----------------MPPLLASTSSTS--PLLLASRLRGGGGC
         PF61417_98__Triticum (1) ----------------MPPLLTSPASLSSSPLRLASRLVG---A
         PF61417_46__Medicago (1) ---------------------------------------------
         PF61417_88__Populus  (1) ---------------------------------------------
         PF61417_90__Populus  (1) ---------------------------------------------
         PF61417_40__Hordeum  (1) ---------------------------------------------
         PF61417_94__Triticum (1) ---------------------------------------------
         PF61417_44__Medicago (1) ---------------------------------------------
         PF61417_96__Triticum (1) ---------------------------------------------
         PF61417_50__Oryza    (1) ---------------------------------------------
    PF61417_64__Physcomitrella(1) ---------------------------------------------
      PF61417_26__Arabidopsis (1) ---------------------------------------------
    PF61417_66__Physcomitrella(1) -----------------MQAVRLSGTICASLLAQSEAQLGAAG
    PF61417_68__Physcomitrella(1) ----------MSQATSFAATAGTLVVASARANASSSCSTTRSSQ
    PF61417_70__Physcomitrella(1) ---------------------------------------------
      PF61417_60__Ostreococcus(1) ---------------------------------------------
         PF61417_36__Hordeum  (1) ---------------------------------------------
         PF61417_38__Hordeum  (1) ---------------------------------------------
      PF61417_62__Ostreococcus(1) ---------------------------------------------
         PF61417_76__Populus  (1) ---------------------------------------------
         PF61417_78__Populus  (1) ---------------------------------------------
         PF61417_134__Medicago(1) ---------------------------------------------
         PF61417_124__Glycine (1) ---------------------------------------------
         PF61417_144__Solanum (1) ---------------------------------------------
         PF61417_146__Solanum (1) ---------------------------------------------
         PF61417_86__Populus  (1) ---------------------------------------------
         PF61417_114__Brassica(1) ---------------------------------------------
      PF61417_4__Arabidopsis  (1) ---------------------------------------------
         PF61417_128__Hordeum (1) ---------------------------------------------
         PF61417_130__Hordeum (1) ---------------------------------------------
```

FIGURE 1 (continued)

```
       PF61417_156__Triticum   (1) ------------------------------------------------
       PF61417_164__Triticum   (1) ------------------------------------------------
         PF61417_56__Oryza     (1) ------------------------------------------------
          PF61417_166__Zea     (1) ------------------------------------------------
          PF61417_170__Zea     (1) ------------------------------------------------
          PF61417_168__Zea     (1) ------------------------------------------------
  PF61417_136__Physcomitrella  (1) ------------------------------------------------
        PF61417_74__Populus    (1) ------------------------------------------------
    PF61417_104__Arabidopsis   (1) ------------------------------------------------
     PF61417_20__Arabidopsis   (1) ------------------------------------------------
       PF61417_110__Brassica   (1) ------------------------------------------------
     PF61417_16__Arabidopsis   (1) ------------------------------------------------
     PF61417_18__Arabidopsis   (1) ------------------------------------------------
     PF61417_14__Arabidopsis   (1) ------------------------------------------------
    PF61417_106__Arabidopsis   (1) ------------------------------------------------
     PF61417_22__Arabidopsis   (1) ------------------------------------------------
       PF61417_108__Brassica   (1) ------------------------------------------------
       PF61417_112__Brassica   (1) ------------------------------------------------
     PF61417_10__Arabidopsis   (1) ------------------------------------------------
       PF61417_116__Brassica   (1) ------------------------------------------------
     PF61417_12__Arabidopsis   (1) ------------------------------------------------
      PF61417_8__Arabidopsis   (1) ------------------------------------------------
        PF61417_118__Glycine   (1) ------------------------------------------------
        PF61417_122__Glycine   (1) ------------------------------------------------
        PF61417_126__Glycine   (1) ------------------------------------------------
       PF61417_132__Medicago   (1) ------------------------------------------------
        PF61417_152__Solanum   (1) ------------------------------------------------
         PF61417_84__Populus   (1) ------------------------------------------------
        PF61417_150__Solanum   (1) ------------------------------------------------
       PF61417_154__Triticum   (1) ------------------------------------------------
       PF61417_162__Triticum   (1) ------------------------------------------------
       PF61417_160__Triticum   (1) ------------------------------------------------
         PF61417_52__Oryza     (1) ------------------------------------------------
        PF61417_142__Solanum   (1) ------------------------------------------------
        PF61417_148__Solanum   (1) ------------------------------------------------
        PF61417_120__Glycine  (46) FEDVEGVKEELKELEGLAQSLRSSHEQSKTLHNAKAVRDLRAGMD
          PF61417_172__Zea     (1) ------------------------------------------------
       PF61417_158__Triticum   (1) ------------------------------------------------
         PF61417_48__Oryza     (1) ------------------------------------------------
  PF61417_138__Physcomitrella  (1) ------------------------------------------------
  PF61417_140__Physcomitrella  (1) ------------------------------------------------
          PF61417_2__Oryza     (1) ------------------------------------------------
       PF61417_102__Medicago   (1) ------------------------------------------------
                   Consensus  (46)
```

FIGURE 1 (continued)

```
                                         91                                    135
       PF61417_100__Zea    (1)  --------------------------MAAPSAAVIGVLVLLVV
       PF61417_54__Oryza   (1)  -----------------------MARGSAAAAIAGVVWVLLLLVG
    PF61417_6__Arabidopsis (1)  -------------------MAISLKRNRFFIPYTNLVFFFFLCVS
       PF61417_82__Populus (1)  ---------------------------------------------
  PF61417_72__Physcomitrella (1) ---------------------------------MGVEVVCQMVKSRV
   PF61417_24__Arabidopsis (21) NSLSKAALSFSRAKPICPFPQTSRRPISVYKSPMNNLFNRLGFGS
   PF61417_28__Arabidopsis (1)  --------------------------------MNILNRLGLGS
   PF61417_30__Arabidopsis (1)  --------------------------------MNILNKLGIGS
      PF61417_32__Glycine  (1)  ---------------------------------MNLLSRIVGLG
      PF61417_34__Glycine  (30) PAKTKFLPSLSRFSVKRPYFLSQTYPRIAVNKPSMNLLNRLGFGS
       PF61417_42__linum   (1)  ---------------------------------MNILNKLGFGF
      PF61417_80__Populus  (26) SKPFLSPSAKSQLSHSKPFNFPRTLKPISYYKPPMNILSKLGFGT
      PF61417_92__Populus  (28) SKPFRSLSSKSLLFLSKPFNFPRTSKPISYYKPSMNILNKLGFGP
       PF61417_58__Oryza   (27) GCGGAPLLHRTRRGFLAPSTTTTQTTRTS--FAAMSWLGKLGLGG
      PF61417_98__Triticum (26) ALRPTPSSSSRSRRFLAPTQTAAPGTTTSGGFAAMSWLGKLGLGG
      PF61417_46__Medicago (1)  -------------------------------------MATSE
      PF61417_88__Populus  (1)  -------------------------------------MATH-
      PF61417_90__Populus  (1)  -------------------------------------MATS-
      PF61417_40__Hordeum  (1)  ---------------------------------------------
      PF61417_94__Triticum (1)  ---------------------------------------------
      PF61417_44__Medicago (1)  ----------------------------------MNLLNKLGFGS
      PF61417_96__Triticum (1)  ---------------------------------------------
       PF61417_50__Oryza   (1)  ---------------------------------------------
  PF61417_64__Physcomitrella (1) ---------------------------------------------
   PF61417_26__Arabidopsis (1)  -------------------MDSSLKTQEPQVVETSPSPVAQEPP
  PF61417_66__Physcomitrella (27) TLHTKAVLLGARPSRSLSVRRGSSFSGTRMASEKGGWMEKLGFGA
  PF61417_68__Physcomitrella (35) LGSSFFDRRLKIRQVTKGSLAKGSQREVTAVRAMDSFLGMLGLGS
  PF61417_70__Physcomitrella (1) --------------------------------MDSFLSMLGFNS
    PF61417_60__Ostreococcus (1) ------------------------------MIGVGGDGIVSAAEA
      PF61417_36__Hordeum  (1)  -------------------------------------------MSF
      PF61417_38__Hordeum  (1)  ---------------------------------------------
    PF61417_62__Ostreococcus (1) ---------------------------------------MQAIRNMF
      PF61417_76__Populus  (1)  ---------------------------------------------
      PF61417_78__Populus  (1)  ---------------------------------------------
     PF61417_134__Medicago (1)  ------------------------MMKPLIWRMASHSLSLSLS
      PF61417_124__Glycine (1)  ----------------------------MASQSLSLPP-
      PF61417_144__Solanum (1)  ---------------------------------------------
      PF61417_146__Solanum (1)  ---------------------------------------------
       PF61417_86__Populus (1)  ---------------------------------------------
      PF61417_114__Brassica (1) -------------------------------MASSSCFTIQSS
    PF61417_4__Arabidopsis (1)  -------------------------------MASSTRLTIIQSS
      PF61417_128__Hordeum (1)  ---------------------------------------------
      PF61417_130__Hordeum (1)  ----------------------------MAVRCHAAATLV
```

FIGURE 1 (continued)

```
PF61417_156__Triticum      (1)  ------------------------------------------
PF61417_164__Triticum      (1)  ------------------------------------------
    PF61417_56__Oryza      (1)  ---------------------------MRQYAAATAASSS
     PF61417_166__Zea      (1)  ------------------------MAARCSTAASVSVVRTGSR
     PF61417_170__Zea      (1)  ------------------------MAARCSTAA--SVVRTGSR
     PF61417_168__Zea      (1)  ------------------------------------------
PF61417_136__Physcomitrella (1) ------------------------------------------
   PF61417_74__Populus     (1)  ------------------------------------------
PF61417_104__Arabidopsis   (1)  ------------------------------------------
PF61417_20__Arabidopsis    (1)  ------------------------------------------
PF61417_110__Brassica      (1)  ------------------------------------------
PF61417_16__Arabidopsis    (1)  ------------------------------------------
PF61417_18__Arabidopsis    (1)  ------------------------------------------
PF61417_14__Arabidopsis    (1)  ------------------------------------------
PF61417_106__Arabidopsis   (1)  -----------------------------MAFNIITPGRVYS
PF61417_22__Arabidopsis    (1)  -----------------------------MAFNIITPGRVYS
PF61417_108__Brassica      (1)  ------------------------------------------
PF61417_112__Brassica      (1)  ---------------------------MALNVIQSSVRVSS
PF61417_10__Arabidopsis    (1)  ------------------------------------------
PF61417_116__Brassica      (1)  ------------------------------------------
PF61417_12__Arabidopsis    (1)  ------------------------------------------
PF61417_8__Arabidopsis     (1)  ------------------------------------------
PF61417_118__Glycine       (1)  ----------------------------MGFNILRTTS
PF61417_122__Glycine       (1)  ----------------------------MGLSILRSTS
PF61417_126__Glycine       (1)  ------------------------------------------
PF61417_132__Medicago      (1)  ----------------------------MMVNILRITP
PF61417_152__Solanum       (1)  ------------------------------------------
   PF61417_84__Populus     (1)  ------------------------------------------
PF61417_150__Solanum       (1)  ------------------------------------------
PF61417_154__Triticum      (1)  -------------MGGVQHLLKLRMASPHAHP------ATQPLS
PF61417_162__Triticum      (1)  -------------MGGVQHLLKLRMASPHAHP------ATRPLS
PF61417_160__Triticum      (1)  ------------------------------------------
    PF61417_52__Oryza      (1)  -------------MGVQHLLKLRMASPHPHPGAPLAARPLS
PF61417_142__Solanum       (1)  ------------------------------------------
PF61417_148__Solanum       (1)  ---------------------------------MGSHI
PF61417_120__Glycine      (91)  GDVSAALKKAKLIKLKLEALERSNAANRNLPGCGPGSSSDRTRTS
     PF61417_172__Zea      (1)  ------------------------------------------
PF61417_158__Triticum      (1)  ------------------------------------------
    PF61417_48__Oryza      (1)  ------------------------------------------
PF61417_138__Physcomitrella (1) -----------------------------MCRPLTIS
PF61417_140__Physcomitrella (1) ------------------------------------------
     PF61417_2__Oryza      (1)  ----------------------------MSWLGKLGLGG
PF61417_102__Medicago      (1)  ------------------------------------------
            Consensus     (91)
```

FIGURE 1 (continued)

```
                                     136                                          180
      PF61417_100__Zea     (18)  GASGARLPG-----RGSTTRGAALPRGGAPATAVFALGSFWRSEA
      PF61417_54__Oryza    (23)  VASGARLPGGSGGNRGREPRGGAAAAAVATETAVFALGSFWRSEA
   PF61417_6__Arabidopsis  (27)  LLDKTVSIR----ISNQISDTVVDSPDRPLKSAVFALGSFWRSEA
      PF61417_82__Populus   (1)  --------------------------------------------
 PF61417_72__Physcomitrella (15)  LYLWAVTVGVLVVQVVAIRPDQTSKNMGETRVASFALGSFWRGEA
  PF61417_24__Arabidopsis  (66)  RP---QAQADPSSAAIAQGPDDDVPSS-GQQFAQFGAGCFWGVEL
  PF61417_28__Arabidopsis  (12)  S-----GQTNMDPSPIAQGNDDDTPAP-GNQFAQFGAGCFWGVEL
  PF61417_30__Arabidopsis  (12)  S-----RQTNMDPSPIAQVIDDEAPAP-GNQFTQFGAGCFWSVEL
     PF61417_32__Glycine   (12)  S----PRAAQNMNSTTAQGPDDEIPAP-GQQFAQFGAGCFWSVEL
     PF61417_34__Glycine   (75)  A-----RATENMDSSIPQGPDDDIPAP-GQQFAEFGAGCFWGVEL
     PF61417_42__linum     (12)  MS---SPDSSSMDPTIPQSPDDDVPSA-GQQFAQFGAGCFWGVEL
     PF61417_80__Populus   (71)  R----SPDPSTMDPTIPQGPDDDLPAP-GQQFAQFGAGCFWGVEL
     PF61417_92__Populus   (73)  R----SPDPSTMDPTIPQGPDDDLPAP-GQQFAQFGAGCFWGVEL
     PF61417_58__Oryza     (70)  LGG--SPRASAASAALAQGPDEDRPAA-GNEFAQFGAGCFWGVEL
     PF61417_98__Triticum  (71)  GG---SPRASEASAALAQGPDEDKPAP-GSEFAQFGAGCFWGVEL
     PF61417_46__Medicago   (6)  GG--------NGNHNTAFDPDLDIPDNPDDEFAEFGAGCFWGVEL
     PF61417_88__Populus    (5)  ------------TTNPALDPDLDKPDNPNHEFAQFGAGCFWGVEL
     PF61417_90__Populus    (5)  ------------TTNPALDPDLDQPDNPNHEFAQFGAGCFWGVEL
     PF61417_40__Hordeum    (1)  ----------MSSSTGAAGPDADAPAGEGLELAQFGAGCFWSVEL
     PF61417_94__Triticum   (1)  ----------MSSTGAAGPDADAAVGEGLELAQFGAGCFWSVEL
     PF61417_44__Medicago  (12)  G-----RSSESMDSTIPQGPDDDIPAP-GQQFAQFGAGCFWGVEL
     PF61417_96__Triticum   (1)  ----------MSSTGASGPDADAAAGEGLELAQFGAGCFWSVEL
     PF61417_50__Oryza      (1)  -----MSDSNPGAANPALGPDADAAAGEGLELAQFAAGCFWSVEL
PF61417_64__Physcomitrella  (1)  ---------------------------MAQLATFAAGCFWSVEL
 PF61417_26__Arabidopsis  (26)  QV---ADKPAIVPSPIAQEPDNDVPAP-GNEFAEFAAGCFWGVEL
PF61417_66__Physcomitrella (72)  RASAAQATGAAGSSTGARSPDDDVPAP-GHEFATFGAGCFWGVEL
PF61417_68__Physcomitrella (80)  HG---PANFDPADVAIAQGPDDDKPVS-GCEFACFGAGCFWGVEL
PF61417_70__Physcomitrella (13)  RR---ASSYNPADVAISEGPDIDKPAS-GNQFACFGAGCFWGVEL
  PF61417_60__Ostreococcus (16)  LPGRAEAMRTPEAHYVLRPNRMTAPWPEGHEVAVIASGCFWGSEK
     PF61417_36__Hordeum    (4)  ARPLISQPFLRSLLTMSGKPVCIDNSTTAAQKATFAAGCFWGVEK
     PF61417_38__Hordeum    (1)  --------------MSGKPACTDNSTTAAQKATFAAGCFWGVEK
  PF61417_62__Ostreococcus  (9)  GGAGGERVPMKINPKHFILKTDVTTVPSGHASFVAATGCFWGSEK
     PF61417_76__Populus    (1)  --------------------------------------------
     PF61417_78__Populus    (1)  --------------------------------------------
     PF61417_134__Medicago (20)  AAAQILPNTQIQKFDSKLLLWPSRLHTKPTTKLSSSIRAMGSSAS
     PF61417_124__Glycine  (11)  --THIPYNRIIGKLDSKFLLWPSCAHIKPR-RISTSIRAMGSSAS
     PF61417_144__Solanum   (1)  ----------------------------------------MGSSAS
     PF61417_146__Solanum   (1)  ----------------------------------------MGSSAS
     PF61417_86__Populus    (1)  ----------------------------------------MGSSAS
     PF61417_114__Brassica (13)  FFSASTRLDSISKPSLSGFACRSLTKPRNLNLSVLLRCSMGSFNS
   PF61417_4__Arabidopsis  (14)  FVSARTRLNYVSKTNHSGFACRSLSKPRNLSLSVYS---MGSSSS
     PF61417_128__Hordeum   (1)  ----------------------------------------MGAAPS
     PF61417_130__Hordeum  (13)  SSRAHLSSYLPPLLPSARPRSTTTRSCGGSSYRRTAVRAMGAAPS
```

FIGURE 1 (continued)

```
         PF61417_156__Triticum    (1)  ---------------------------------------MGAAPS
         PF61417_164__Triticum    (1)  ---------------------------------------MGAAPS
           PF61417_56__Oryza     (14)  FRARPRARPSCLPAAALPLAPCCGVAWSRASYRRASVRAMGAASS
           PF61417_166__Zea      (20)  DLSPSFSFTAAALPSARLRPVGAWVRGGGYTCRLRAVCAMGSAPS
           PF61417_170__Zea      (18)  DLSPSFSFTAAALPSARLRPVGAWVRGGGYTCRLRAVCAMGSAPS
           PF61417_168__Zea       (1)  --------------------------------------------
    PF61417_136__Physcomitrella   (1)  ---------------------------------------MGAGMS
          PF61417_74__Populus     (1)  ---------------------------------------MGRLPA
       PF61417_104__Arabidopsis   (1)  --------------------------------------------
        PF61417_20__Arabidopsis   (1)  --------------------------------------------
         PF61417_110__Brassica    (1)  --------------------------------------------
        PF61417_16__Arabidopsis   (1)  --------------------------------------------
        PF61417_18__Arabidopsis   (1)  --------------------------------------------
        PF61417_14__Arabidopsis   (1)  -------------------------------------------M
       PF61417_106__Arabidopsis  (14)  ATSLTFVSTIKAAFVKPPLASPSRR--------NLLRFSSSPLSF
        PF61417_22__Arabidopsis  (14)  ATSLTFVSTIKAAFVKPPLASPSRR--------NLLRFSSSPLSF
         PF61417_108__Brassica    (1)  --------------------------------------------
         PF61417_112__Brassica   (15)  ATSLTFSSAIKSFVTPSLPLATHRFSLSPSPNLNLLRIPSSPPSF
        PF61417_10__Arabidopsis   (1)  --------------------------------------------
         PF61417_116__Brassica    (1)  --------------------------------------------
        PF61417_12__Arabidopsis   (1)  --------------------------------------------
         PF61417_8__Arabidopsis   (1)  --------------------MNIVNSKILFLSFTLLLLLQSSIV
          PF61417_118__Glycine   (11)  ISTPISSSKSKPIFSTLLRSSPSTIFPPKSVTPTTLFVSATPFFT
          PF61417_122__Glycine   (11)  ISTPISSSKSKPIFSTLVRSSFASISPTKCVTPTTLFVSATPFFT
          PF61417_126__Glycine    (1)  --------------------------------------------
         PF61417_132__Medicago   (11)  LS---SFNVTKPISS--IRSN-----------PTFLFNSLPTISI
          PF61417_152__Solanum    (1)  --------------------MDSQILKFWPIIPSKNLIFNSKK
           PF61417_84__Populus    (1)  --------------------------------------------
          PF61417_150__Solanum    (1)  --------------------------------------------
         PF61417_154__Triticum   (26)  ALPSLLLARSSSAAASSARPAASLSLPLSCSR------ARAYCPA
         PF61417_162__Triticum   (26)  SLPSLLLARSSSAATAAASSARPASLSLSCSRS----RARAYCPA
         PF61417_160__Triticum    (1)  --------------------------------------------
           PF61417_52__Oryza     (31)  ALASFFLARPSSTAAAPPPRHVTLSCSRPHCNHNQWAASRCRGTA
          PF61417_142__Solanum    (1)  --------------------------------------------
          PF61417_148__Solanum    (6)  LKISPFASSTPLFINATPFLRFQAKKVVSICGHPKTQFRFSSSSS
          PF61417_120__Glycine  (136)  VVNGLKKKLKDSMESFNEIRGLVSSEYRETVQRRYFTVTGENPDD
           PF61417_172__Zea       (1)  --------------------------------------------
         PF61417_158__Triticum    (1)  --------------------------------------------
           PF61417_48__Oryza      (1)  --------------------------------------------
    PF61417_138__Physcomitrella   (9)  LAMASMLSTVVTNTTIAKPASAARSFKAASNAASLRPSVFKLTHN
    PF61417_140__Physcomitrella   (1)  --------------------------------------------
           PF61417_2__Oryza      (12)  LGG--SPRASAASAALAQGPDEDRPAA-GNEFAQFGAGCFWGVEL
         PF61417_102__Medicago    (1)  ---------------------------------------MGSSAS
                    Consensus  (136)
                                                                          motif 4
```

FIGURE 1 (continued)

```
                                   181                                      225
      PF61417_100__Zea       (58)  AFGC---LHGVIRTSVGYAGG------SKSNPEYRNLA------D
      PF61417_54__Oryza      (68)  AFGC---LPGVIRTSVGYAGG------SKARPEYRNLG------D
 PF61417_6__Arabidopsis      (68)  AFGC---INGVVRTSAGYAGG------TKTNPEYRNLG------D
    PF61417_82__Populus       (1)  ---------------------------------------------
PF61417_72__Physcomitrella   (60)  AFGC---LPGVVRTRAGYAGG------LKQNPDYHSVG------D
 PF61417_24__Arabidopsis    (107)  AYQR---VPGVTKTEVGYSHG------IVHNPSYEDVCTGT---T
 PF61417_28__Arabidopsis     (51)  AFQR---VPGVTQTEAGYTQG------TVDNPSYGDVCSGT---T
 PF61417_30__Arabidopsis     (51)  AYQR---VPGVTQTEVGYSQG------ITHDPSYKDVCSGT---T
    PF61417_32__Glycine      (52)  AFQR---ASGVTKTEVGYSQG------QLPNPSYEDVCTGT---T
    PF61417_34__Glycine     (114)  AFQR---VPGVTKTEVGYTQG------LVHNPTYEDVCTGT---T
     PF61417_42__linum       (53)  AFQR---VPGVTKTEVGYTQG------LLHNPSYQDICTGT---T
    PF61417_80__Populus     (111)  AFQR---VPGVTKTEVGYTQG------LSHNPSYEDVCTGT---T
    PF61417_92__Populus     (113)  AFQR---VPGVTKTEVGYTQG------LLHNPSYEDVCSGT---T
     PF61417_58__Oryza      (112)  AFQR---VPGVTRTEVGYSQG------NLHDPTYEDVCTGA---T
   PF61417_98__Triticum    (112)  VFQR---VPGVTRTEVGYSQG------AFHDPTYEDVCTGA---T
   PF61417_46__Medicago     (43)  AFQR---VPGVVKTEVGYTQG------HTPDPNYKLVCTGT---T
    PF61417_88__Populus     (38)  AFQR---LHGVVKTEVGYSQG------NVPDPTYKLVCTKT---T
    PF61417_90__Populus     (38)  AFQR---LPGVVKTEVGYSQG------HVPDPTYKLVCTNT---T
    PF61417_40__Hordeum     (36)  AYQR---LPGVARTEVGYSQG------DLDGPTYRDVCGGG---T
   PF61417_94__Triticum     (35)  AYQR---LPGVARTEVGYSQG------HLDGPTYRDVCGGG---T
   PF61417_44__Medicago     (51)  VFQR---VPGVSKTEVGYTQG------LLHNPTYEDVCSGT---T
   PF61417_96__Triticum     (35)  AYQR---LPGVARTEVGYSQG------HLDGPTYRDVCGGG---T
     PF61417_50__Oryza      (41)  TYQR---LPGVARTEVGYSQG------HREPTYRDVCGGG---T
PF61417_64__Physcomitrella  (18)  AFQR---VPGVTKTSVGYTQG------KTENPTYRDVCSGK---T
 PF61417_26__Arabidopsis    (67)  AFQR---IPGVTVTEVGYTHG------ISHNPSYEDVCTNT---T
PF61417_66__Physcomitrella (116)  AFQR---VHGVSHTEVGYTQG------HIDNPDYYAVCSGD---T
PF61417_68__Physcomitrella (121)  AYQR---VPGVKTEVGYTQG------QMHMPTYEAVCSGM---T
PF61417_70__Physcomitrella  (54)  AYQR---VPGVTYTEVGYTQG------QLHNPTYEAVCSGD---T
  PF61417_60__Ostreococcus  (61)  GAWR---IPGVYSTAVGYVGG------HTKNPTYEEACSGR---T
    PF61417_36__Hordeum     (49)  MCRESFASRGLVEARVGYTGG------LSSNPLYRAVCSGQ---T
    PF61417_38__Hordeum     (31)  MFRESFTSRGLVEARVGYTGG------LSSNPLYRAVCSGQ---T
  PF61417_62__Ostreococcus  (54)  MFWR---VPGVRATSVGYIAG------KIEHPTYEEICGGR---T
    PF61417_76__Populus     (18)  LAAVGGWRLLAAGNANAAGSGAQSFEVTLSDEAWRQKLTPA----
    PF61417_78__Populus      (1)  -------------MTAFDLTP----PTATQTEALVAGLSSE----
  PF61417_134__Medicago     (65)  SNSNN--PNTTEIQSGSSPVD----YKSLSDAEWKKQLTDE----
   PF61417_124__Glycine     (53)  SHSQSQYADSVESEAGADTID----YKSLTDEEWKKRLTNE----
   PF61417_144__Solanum      (7)  SSKSDS-------VQGGSKMD----YSSISDEEWKKKLTNE----
   PF61417_146__Solanum      (7)  SSKSDS-------VQGGSKMD----YSSISDEEWKKKLTNE----
    PF61417_86__Populus      (7)  SSQKP--------DNTQGDVN----YASVSDGEWKKKLTAE----
   PF61417_114__Brassica    (58)  SQKSDN-------VQEAAKSD----FASISEGEWKKRLTPE----
  PF61417_4__Arabidopsis    (56)  SPKPDN-------VQEAEKNE----FASLSENEWKKRLTPE----
    PF61417_128__Hordeum     (7)  S-------PSPSGQAPGKVDN-----ASLSDEELKKRLTKE----
    PF61417_130__Hordeum    (58)  S-------PSPSGQAPGKVDN-----ASLSDEELKKRLTKE----
```

FIGURE 1 (continued)

```
            PF61417_156__Triticum    (7) S-------PSPSGQAPGKADN-----ASLSDEELKKRLTKE----
            PF61417_164__Triticum    (7) S-------PSPSGQAPGKADN-----ASLSDEELKKRLTKE----
             PF61417_56__Oryza      (59) SSSSSSSSPSPQGQAQAQAQGKPNYSTSLTDEEWRKRLTKD----
             PF61417_166__Zea       (65) SSQSPSP-HTPSGQTQGKADY-----KSLSEEEWKKRLTEE----
             PF61417_170__Zea       (63) SSQSPSP-HTPSGQTQGKADY-----KSLSEEEWKKRLTEE----
             PF61417_168__Zea        (1) ----MLC-ASPLSALNNFAVD-----DFVRNRRQRRRLTEE----
       PF61417_136__Physcomitrella   (7) ARSDVRPAAVPKASGDVSEQT---DYKTFSDEEWKKRLSQQ----
             PF61417_74__Populus     (7) R---------LGFLHRDQLFIMSFPIHKTEQEWQAELQAKGAEP
          PF61417_104__Arabidopsis   (1) --------MPTSATAVAPSTG----SVQKKDQDWRAILSPE----
           PF61417_20__Arabidopsis   (1) --------MPTSATAVAPSTG----SVQKKDQDWRAILSPE----
            PF61417_110__Brassica    (1) --------MATTATSAAPSPG----SVQKHDEEWRAVLSPE----
           PF61417_16__Arabidopsis   (1) --------MAAMTAAAVPATG----SFQKQDEEWRAVLSPE----
           PF61417_18__Arabidopsis   (1) --------MAMTAAAVPSSG-----SFQKQDEEWRAVLSPE----
           PF61417_14__Arabidopsis   (2) NTSPKMEMEMKMETKAAPEAG----MIKKSNEEWRTVLSPE----
          PF61417_106__Arabidopsis  (51) PSLRRGFHGGRIVAMGSSAPE----SVNKPEEEWRAILSPE----
           PF61417_22__Arabidopsis  (51) PSLRRGFHGGRIVAMGSSAPE----SVNKPEEEWRAILSPE----
            PF61417_108__Brassica    (1) ---------------MSSPAPG----SVNKPEEEWRAILSPE----
            PF61417_112__Brassica   (60) SSLRRGFRGGRITAMASSAPG----SVNKPEEEWRAVLSPE----
           PF61417_10__Arabidopsis   (1) ---------------MADLVT----VVKKTEEEWRAVLSPE----
            PF61417_116__Brassica    (1) ---------------MAAAHGR----VVQKTEEEWRAILSPE----
           PF61417_12__Arabidopsis   (1) ---------------MAASPL----VVQKTEEEWRAILSPE----
            PF61417_8__Arabidopsis  (25) ESDSICLSSGVASTVAMAAPG----SVQKGDEEWRAILSPE----
             PF61417_118__Glycine   (56) LHPKLGFRGGIVAMAAP---G----SLRKSEEEWRAILSPE----
             PF61417_122__Glycine   (56) ASPKRGFRGGIVAMAAA---G----SLRKSEEEWRAILSPE----
             PF61417_126__Glycine    (1) -------------MAAA---G----SLRKSKEEWRAVLSPE----
            PF61417_132__Medicago  (40) RQPKRGFRGGIVAMSAAPTPG----SVQKSEEEWQAILSPE----
             PF61417_152__Solanum  (24) AVPIRGLSNTRFRVAAA---G----SVQKSEEEWRAILSPD----
             PF61417_84__Populus    (1) -------------MAGG---G----SVQKTEEEWRAVLSPE----
             PF61417_150__Solanum   (1) -------------------M----AVEKSEEEWRAILSPE----
            PF61417_154__Triticum  (65) GRRLPGAVVAMSSSAPAPGP------VQKSEEEWEAVLTPE----
            PF61417_162__Triticum  (67) GRRLPGAVVAMSSAAPTPGP------VQKSEEEWEAVLTPE----
            PF61417_160__Triticum   (1) ----------MSSSAPAPGP------VQKSEEEWEAVLTPE----
             PF61417_52__Oryza     (76) GRRRLQVVVAMSSSAPPPPG----SVQKSEEEWEAILSPE----
            PF61417_142__Solanum    (1) -------------MAAP---D----SVHKSEEDWRAILSPE----
            PF61417_148__Solanum   (51) SSSKRGFRGGVVAMAAP---D----SVHKSEEDWRAILSPE----
             PF61417_120__Glycine (181) KTLDLLISTVWSIWEKMAAPT----PIHKTEEEWKVILSPE----
              PF61417_172__Zea      (1) ---------------------------------------------
            PF61417_158__Triticum   (1) -------------MASGDS------KPRSEEEWRAVLNPE----
             PF61417_48__Oryza      (1) -------------MASSGDSS----GKQRSDEEWRAVLSPE----
       PF61417_138__Physcomitrella (54) PTLRFEARRGVAMASAGGAET----QVQKSEEEWRAILSPE----
       PF61417_140__Physcomitrella  (1) ------------MASAGGSGT----QVRKSDEEWRAILSPE----
              PF61417_2__Oryza     (54) AFQR---VPGVTRTEVGYSQG------NLHDPTYEDVCTGA---T
             PF61417_102__Medicago  (7) SNSNN--PNTTEIQSGSSPVD----YKSLSDAEWKKQLTDE----
                        Consensus (181) A          GV      G  G         SDEEWR VLS E
                                                        motif 4
                                                                    motif 8
```

FIGURE 1 (continued)

```
                                        226                                          270
       PF61417_100__Zea   (88)  -HAECVKVEYDPRLIHYRQLLDVFWASHDPREVFGQGPDVGNQYR
       PF61417_54__Oryza  (98)  -HAECVKVEYDPRLIQYKKLLEVFWASHDPREVFGQGPDVGNQYR
  PF61417_6__Arabidopsis  (98)  -HAESVQVEYDPRIIGYRQLLDVFWSSHDSRQVFGQGPDVGNQYR
     PF61417_82__Populus   (1)  --MQFDYVEYDPKVISYSQLLEVFWASHDSRQVFGQGPDVGNQYR
PF61417_72__Physcomitrella (90)  -HAEAVEVEYNPSMISFEQLLKVFWANHDPTQIFGQGPDVGPQYR
 PF61417_24__Arabidopsis (140)  GHNEVVRVQYDPKECSFESLLDVFWNRHDPTTLNRQGGDVGTQYR
 PF61417_28__Arabidopsis  (84)  GHSEVVRVQYDLNDCTYESLLDLFWSRHDPTTLNRQGNDVGTQYR
 PF61417_30__Arabidopsis  (84)  NHAEIVRVQYDPKECSYQSLLDLFWSKHDPTTLNRQGNDVGTQYR
     PF61417_32__Glycine  (85)  HHSEVVRVQYDPNVCSYESLLDVFWARHDPTTLNRQGNDVGTQYR
     PF61417_34__Glycine (147)  NHSEVVRIQYDPKNCSYETLLDMFWSRHDPTTLNRQGNDVGTQYR
      PF61417_42__linum   (86)  SHSEVVRVQYDPKECSYDSLLDVFWARHDPTTLNRQGNDVGTQYR
     PF61417_80__Populus (144)  KHSEVVRVQYDPKEGSFETLLDAFWARHDPTTLNRQGNDVGTQYR
     PF61417_92__Populus (146)  NHNEVVRVQYDPKECSFDTLLDVLWARHDPTALNRQGNDVGTQYR
      PF61417_58__Oryza  (145)  YHNEVVRVHYDVSACKFDDLLDVFWARHDPTTPNRQGNDVGTQYR
    PF61417_98__Triticum (145)  GHNEVVRVQYDPAACKYDDLLETFWARHDPTTPNRQGGDVGTQYR
    PF61417_46__Medicago  (76)  NHVEVVRVQFDPKLCPYTNLLDLFWSRHDPTTLNRQGGDVGAQYR
     PF61417_88__Populus  (71)  NHVEVVRVQFDPEVCPYTNLLSLFWSRHDPTTLNRQGGDVGTQYR
     PF61417_90__Populus  (71)  NHVEVVRVQFDPEVCPYTNLLSLFWSRHDPTTLNRQGGDVGTQYR
     PF61417_40__Hordeum  (69)  GHSEVVRVHYDPKDCPYAVLLDVFWAKHNPTTLNKQGNDVGTQYR
    PF61417_94__Triticum  (68)  GHAEVVRVHYDPKECPYAVLLDVFWAKHNPTTLNKQGNDVGTQYR
    PF61417_44__Medicago  (84)  NHNEVVRVQYDPKQGTFENLLDTFWSKHDPTTPNRQGNDVGTQYR
    PF61417_96__Triticum  (68)  GHAEVVRVHYDPKECPYAVLLDVFWAKHNPTTLNKQGNDVGTQYR
      PF61417_50__Oryza   (74)  GHAEVVRVHYDPKACPYEVLLDVFWAKHNPTTLNKQGNDVGTQYR
PF61417_64__Physcomitrella (51)  GHVEAVQMEYDPSQVSYKQLLDVFWKKHDPTQKNRQGNDVGSQYR
 PF61417_26__Arabidopsis (100)  NHAEVVRVQYDPKECTYETLLDLFWSRHNPTTLNRQGELLGAQYR
PF61417_66__Physcomitrella (149)  GHSEVVRVQYDPKECSYNTLLDVFWKRHDPTTLNRQGNDRGTQYR
PF61417_68__Physcomitrella (154)  GHSEVVRVQYNPAEVSYETLLGVFWDRHDPTTLNRQGGDVGTQYR
PF61417_70__Physcomitrella (87)  GHSEVVRLQYNPAEVSYEDLLNVFWNRHDPTTLNRQVGDSGPQYR
  PF61417_60__Ostreococcus (94)  GHTEGVQIVFDPNVVSYADILALFWTSHDPTQGMRQGNDRGTQYR
     PF61417_36__Hordeum  (85)  GHSEALQVTFDPQKVSYRQLVEFFYQMHDPTTFHRQGADQGSQYR
     PF61417_38__Hordeum  (67)  GHSEALQVTFDPQKVSYRQLVEFFYQMHDPTTFHRQGADQGSQYR
  PF61417_62__Ostreococcus (87)  GHAECVRVIYDPKIVSFADLLAMHWTSHDPTQGDGQGNDRGTQYR
     PF61417_76__Populus  (59)  -QYTVLRHEGTERPFSSPLNDEHRKGVFSCAGCQLDLFSSSTKFD
     PF61417_78__Populus  (25)  -ERRVLLQHGTEAPFCGVFLDNKREGVYCCRLCALPLFRSSTKFD
   PF61417_134__Medicago (100)  -QFYVTRKKGTERAFTGEYWNTKTEGTYHCICCDTPLFESSTKFN
    PF61417_124__Glycine  (90)  -QFYITRQKGTERAFTGEYWNTKTPGIYHCICCDTPLFESSTKFN
    PF61417_144__Solanum  (37)  -QFYITRQKGTERAFTGEYWNSKTPGTYHCICCDTPLFESSTKFD
    PF61417_146__Solanum  (37)  -QFYITRQKGTERAFTGEYWNSKTPGTYHCICCDTPLFESSTKFD
     PF61417_86__Populus  (36)  -EFYVTRQKGTERAFSGEYWNTKTPGTYHCICCNTPLFESSTKFD
    PF61417_114__Brassica (88)  -QYYITRQKGTERAFTGEYWNTKTPGVYKCICCDTPLFDSSTKFD
   PF61417_4__Arabidopsis (86)  -QYYITRQKGTERAFTGEYWNSKTPGVYNCVCCDTPLFDSSTKFD
    PF61417_128__Hordeum  (36)  -QYYVTRQKGTERAFTGEYWNTKTPGVYHCICCDTPLLESSTKFD
    PF61417_130__Hordeum  (87)  -QYYVTRQKGTERAFTGEYWNTKTPGVYHCICCDTPLFESSTKFD
```

FIGURE 1 (continued)

```
      PF61417_156__Triticum     (36)  -QYYVTRQKGTERAFTGEYWNTKTPGIYHCICCDTPLFESSTKFD
      PF61417_164__Triticum     (36)  -QYYVTRQKGTERAFTGEYWNTKTPGIYHCICCDTPLFESSTKFD
         PF61417_56__Oryza     (100)  -QYYITRQKGTERAFTGEYWNTKTPGIYHCVCCDTPLFESSTKFD
         PF61417_166__Zea      (100)  -QYYVTRQKGTERAFTGEYWNTKTPGIYQCVCCDTPLFQSSTKFD
         PF61417_170__Zea       (98)  -QYYVTRQKGTERAFTGEYWNTKTPGIYQCVCCDTPLFQSSTKFD
         PF61417_168__Zea       (32)  -QYYVTRQKGTERAFTGEYWNTKTPGIYQCVCCDTPLFQSSTKFD
  PF61417_136__Physcomitrella   (45)  -QFYVARKKGTERPFTGEYWNTKAGTYLCVCCKTPLFSSKTKFD
         PF61417_74__Populus    (42)  AAFQVTRHAATERPFTGRYEQFWADGSYHCICCGSKLFDSDTKFD
     PF61417_104__Arabidopsis   (30)  -QFRVLREKGTENRGKGEYTKLFDDGIYSCAGCATPLYKSTTKFD
      PF61417_20__Arabidopsis   (30)  -QFRVLREKGTENRGKGEYTKLFDDGIYSCAGCATPLYKSTTKFD
       PF61417_110__Brassica    (30)  -QFRVLRKKGTEARFKGEYTKLFEEGTYACAGCATPLYKSTTKFD
      PF61417_16__Arabidopsis   (30)  -QFRVLRLKGTDKRGKGEFTKKFEEGTYSCAGCGTALYKSTTKFD
      PF61417_18__Arabidopsis   (29)  -QFRVLRLKGTDKRGKGEFTKKFEEGTYSCAGCGTALYKSTTKFD
      PF61417_14__Arabidopsis   (39)  -QFKILREKSIEKRGSGEYVKLFEEGIYCCVGCGNPVYKSTTKFD
     PF61417_106__Arabidopsis   (88)  -QFRILRQKGTEYPGTGEYNKVFDDGIYCCAGCGTPLYKSTTKFD
      PF61417_22__Arabidopsis   (88)  -QFRILRQKGTEYPGTGEYNKVFDDGIYCCAGCGTPLYKSTTKFD
       PF61417_108__Brassica    (24)  -QFRILRQKGTEYPGTGEYNKLFEDGIYSCAGCGTPLYKSATKFD
       PF61417_112__Brassica    (97)  -QFRILRQKGTEYPGTGEYNKVFADGIYSCAGCETPLYKSATKFD
      PF61417_10__Arabidopsis   (23)  -QFRILRQKGTETPGTEEYDKFFEEGIFSCIGCKTPLYKSTTKFD
       PF61417_116__Brassica    (24)  -QFRILRQKGTEIPGTGEYDKFFEDGIFSCVGCKTPLYKSTTKFD
      PF61417_12__Arabidopsis   (23)  -QFRILRQKGTEKPGTGEYDKFFEEGIFDCVGCKTPLYKSTTKFD
       PF61417_8__Arabidopsis   (62)  -QFRILRQKGTEYPGTGEYVNFDKEGVYGCVGCNAPLYKSTTKFN
       PF61417_118__Glycine     (90)  -QFRILRQKGTEFPGTGEYDKFYEEGVYNCAGCGTPLYRSITKFN
       PF61417_122__Glycine     (90)  -QFRILRQKGTEFPGTGEYDKFFDEGVYNCAGCGTPLYRSLTKFN
       PF61417_126__Glycine     (22)  -QFRILRQKGTEFPGTGEYDKFFDEGVYNCAGCGTPLYRSLTKFN
       PF61417_132__Medicago    (77)  -QFRILRQKGTEYPGTGEYDKFFGEGVYSCAGCGTPLYKSTTKFN
       PF61417_152__Solanum     (58)  -QFRILRQKGTETQGSGEYNKFFGVGTYLCAGCGTPLYRSATKFN
        PF61417_84__Populus     (22)  -QFHILRDKGTEPKFSGEYDKFFEQGVFNCAGCGTPLYKSTTKFN
       PF61417_150__Solanum     (18)  -QFRILRQKGTELKGSGEYDKFFDEGIYNCAGCGTPLYKSSTKFD
       PF61417_154__Triticum   (100)  -QFRILRRKGTEYPGTGEYDKFFSEGIYGCAGCGTPLYKSSTKFN
       PF61417_162__Triticum   (102)  -QFRILRRKGTEYPGTGEYDKFFSEGIYGCAGCGTPLYKSSTKFN
       PF61417_160__Triticum    (26)  -QFRILRRKGTEYPGTGEYDKFFSEGIYGCAGCGTPLYKSSTKFN
         PF61417_52__Oryza     (113)  -QFRILRLKGTEYPGTGEYDKLFAEGVYECAGCGTPLYKSSTKFN
       PF61417_142__Solanum     (22)  -QFRILRQKGTEYPGTGEYDKFSGEGVYQCAGCSTPLYKSTAKFN
       PF61417_148__Solanum     (85)  -QFRILRQKGTEYPGTGEYDKFSGEGVYQCAGCSTPLYKSTAKFN
       PF61417_120__Glycine    (218)  -QFRILRQKGTELKGTGEYNKFFEEGIYNCAGCGTPLYKSSTKFD
         PF61417_172__Zea        (1)  --------MSRLPGTGEYNKFYGDGVYNCAGCGTPLYKSATKFD
       PF61417_158__Triticum    (22)  -QFRILRLKGTELPGTGEYNKFYGDGAYKCAGCGTPLYKSTTKFD
         PF61417_48__Oryza      (25)  -QFRILRLKGTELPGTGEYNKFYGDGVYNCAGCGTPLYKSTTKFD
  PF61417_138__Physcomitrella   (91)  -QFRILRQKGTEYPGTGEYNKNAEGVYNCAGCGTPLYKSTTKFD
  PF61417_140__Physcomitrella   (26)  -QFRILRKKGTEYPNSGEYNKTYNDGVYNCAGCEAPLYKSTTKFD
         PF61417_2__Oryza       (87)  YHNEVVRVHYDVSACKFDDLLDVFWARHDPTTPNRQGNDVGTQYR
       PF61417_102__Medicago    (42)  -QFYVTRKKGTERAFTGEYWNTKTEGTYHCICCDTPLFESSTKFN
                  Consensus    (226)   QF VLR KGTE   TGEY     GIY C  C TPLYDSSTKF
                                              motif 4              motif 1
                                        motif 8              motif 9 motif 6
```

FIGURE 1 (continued)

```
                                              271                                           315
              PF61417_100__Zea   (132)  SVIFTNGTIEARLAGLSKEKEQAKDRSS---VVTTQIQ-PLGVFH
              PF61417_54__Oryza  (142)  SIIFTNGSVEARLAGLSKEKEQAKDRRS---VITTQIQ-PIGAFY
        PF61417_6__Arabidopsis   (142)  SCIFTNSTEELRLASTSKEREQLNTRSS---IVTTQIQ-QLGTFY
              PF61417_82__Populus (44)  SVIFTNGTEERRLAGVSKEREQLKLRSS---VVVTQIQ-QLGTFY
      PF61417_72__Physcomitrella (134)  SVVFTQDDEEAAVAAKSKAAEQNKLPQS---EVVTEIQ-SMGVFY
        PF61417_24__Arabidopsis  (185)  SGIYYYTDEQERIAREAVEKQQKILNK----RIVTEIL-PATKFY
        PF61417_28__Arabidopsis  (129)  SGIYFYTPEQEKLARESLERHQQQMER----KIMTEIL-PAKKFY
        PF61417_30__Arabidopsis  (129)  SGIYFYNPEQEKLARESLERHQQQVDR----KVVTEIL-PAKKFY
           PF61417_32__Glycine   (130)  SGIYYYTPEQEKAAIESLEQQQKKLNR----KIVTEIL-PAKKFY
           PF61417_34__Glycine   (192)  SGIYYYTPEQEKAAKESLEQQQKQLNR----KIVTEIL-PAKKFY
            PF61417_42__linum    (131)  SGIYYYTPEQEEAAKASKERHQKLYNR----NIVTEIL-PAKKFY
           PF61417_80__Populus   (189)  SGIYYYTPEQEKAAKESMEQQQKLSNR----KIVTEIL-PAKKFY
           PF61417_92__Populus   (191)  SGIYYYTPEQEKAARESLERQQKLLNR----KIVTEIL-PAKKFY
            PF61417_58__Oryza    (190)  SGIYYYTPEQEKAARESLEKQQKLLNR----TIVTEIL-PAKRFY
           PF61417_98__Triticum  (190)  SGIYYYTSEQEKAALESMEKQQKVQNR----KIVTEIL-PAKRFY
           PF61417_46__Medicago  (121)  SGIYYYNETQSRLAQESKEAKQLEHKD----KIVTEIL-PAKRFY
           PF61417_88__Populus   (116)  SGIYYYNEAQAKLAQESKEAKQLGLKDN---TVVTEIL-PAKRFY
           PF61417_90__Populus   (116)  SGIYYYNEAQAKLAQESKEAKQLELKDS---KVVTEIL-PAKRFF
           PF61417_40__Hordeum   (114)  SGIYYYTAEQERQARESLAEKQREWKE----KIVTEVL-PARRFY
           PF61417_94__Triticum  (113)  SGIYYYTAEQERQARESLAEKQREWKE----KIVTEVL-PARRFY
           PF61417_44__Medicago  (129)  SGIYFYTPEQEKIAKESLEQQEKQLGR----KIATEIL-PAKKFY
           PF61417_96__Triticum  (113)  SGIYYYTAEQERQARESLAEKQREWKE----KIVTEVL-PARRFY
            PF61417_50__Oryza    (119)  SGIYYYTAEQEKAARDSLAEKQKEWKE----RIVTEIL-PATRFY
      PF61417_64__Physcomitrella  (96)  SGIYYHTEEQKVEAIASMKEEEARLKK----QIATEIL-PATTYY
        PF61417_26__Arabidopsis  (145)  SGIYFYTPEQEKLARESLEKEQKKLED----KIVTEIL-PAKKFY
      PF61417_66__Physcomitrella (194)  SGIYFYSPEQEKAALESKEQVQKTLSN----PIVTEIL-PAKKFY
      PF61417_68__Physcomitrella (199)  SGIYTYTPEQERIAKQSLENHQRSLNR----KIVTEIL-PAKKFY
      PF61417_70__Physcomitrella (132)  SGIYYYSPEQERVAKESLANHQKSLSR----KIVTEVL-PAKKFY
        PF61417_60__Ostreococcus (139)  SGIYCTTDAQLKMALDSKEAYERALKASGRGSITTEIKGPGDVFY
           PF61417_36__Hordeum   (130)  SAIFYHNQEQEQVARQVTQKVNEQWWKN---KVTTEIV-PAGEWW
           PF61417_38__Hordeum   (112)  SAIFYHNQEQEQVARQVTQKVNEQWWKN---KVTTEIA-PAGEWW
        PF61417_62__Ostreococcus (132)  SGLYCSTDEQLKMARDSREADHDRDQGARGYFLLRRGLPSAVLGC
           PF61417_76__Populus   (103)  SGTGWPSFWAPLANAVGTTEDRTFG------MVRTAVH-CR----
           PF61417_78__Populus    (69)  SGTGWPSFFAPFDPAHVREIRDTSHGM-----VRTEIT-CA----
           PF61417_134__Medicago (144)  SGTGWPSYYQPIGKNVKSKLDLSIIFM-----PRQEVL-CA----
           PF61417_124__Glycine  (134)  SGTGWPSYYQTIGKNVKSKLDLSIIFM-----PRQEVL-CA----
           PF61417_144__Solanum   (81)  SGTGWPSYYQPIDNNVKSKMDLSIIFM-----PRQEVL-CA----
           PF61417_146__Solanum   (81)  SGTGWPSYYQPIDNNVKSKMDLSIIFM-----PRQEVL-CA----
           PF61417_86__Populus    (80)  RGTGWPSYYQPIGNNVKSKLDLSIIFM-----PRQEVL-CA----
           PF61417_114__Brassica (132)  SGTGWPSYYQPIGNNVKSKLDLSIIFM-----PRQEVI-CA----
        PF61417_4__Arabidopsis   (130)  SGTGWPSYYQPIGNNVKTKLDLSIIFM-----PRQEVV-CA----
           PF61417_128__Hordeum   (80)  SGTGWPSYYQPVGDNVKSKLDMSIFFM-----PRTESL-CA----
           PF61417_130__Hordeum  (131)  SGTGWPSYYQPVGDNVKSKLDMSIFFM-----PRTESL-CA----
```

FIGURE 1 (continued)

```
PF61417_156__Triticum      (80)  SGTGWPSYYQPVGDNVKSKLDMSIFFM-----PRTESL-CA----
PF61417_164__Triticum      (80)  SGTGWPSYYQPVGDNVKSKLDMSIFFM-----PRTESL-CA----
 PF61417_56__Oryza        (144)  SGTGWPSYYQPIGDNVKCKLDMSIIFM-----PRTEVL-CA----
 PF61417_166__Zea         (144)  SGTGWPSYYKPIGENVKSKLDMSIIFM-----PRTEVL-CA----
 PF61417_170__Zea         (142)  SGTGWPSYYKPIGENVKSKLDMSIIFM-----PRTEVL-CA----
 PF61417_168__Zea          (76)  SGTGWPSYYKPIGENVKSKLDMSIIFM-----PRTEVL-CA----
PF61417_136__Physcomitrella (89) SGTGWPSYYDTIGDNVKSHMDWSIPFM-----PRTEVV-CA----
 PF61417_74__Populus       (87)  AGCGWPSFDRAIPGAITEIVDRSHGMV------RTETV-CS----
PF61417_104__Arabidopsis   (74)  SGCGWPSFFDAIPGAIKQTVID-----------------------
PF61417_20__Arabidopsis    (74)  SGCGWPSFFDAIPGAIKQTPEAGGR--------RMEIT-CA----
PF61417_110__Brassica      (74)  SGCGWPAFFDAIPGAIIQTLEPDGK--------RVEIT-CA----
PF61417_16__Arabidopsis    (74)  SGCGWPAFFDAIPGAIKQTPEAGGR--------RMEIT-CA----
PF61417_18__Arabidopsis    (73)  SGCGWPAFFDAIPGAIKQTPEAGGR--------RMEIT-CA----
PF61417_14__Arabidopsis    (83)  SGCGWPAFFDAIPGAINRTEERAGL--------RYEIT-CT----
PF61417_106__Arabidopsis  (132)  SGCGWPAFFDGLPGAITRTMGDESR--------------------
PF61417_22__Arabidopsis   (132)  SGCGWPAFFDGLPGAITRTPDPDGR--------RIEIT-CA----
PF61417_108__Brassica      (68)  SGCGWPAFFDGLPGAINRTPDPDGR--------RIEIT-CA----
PF61417_112__Brassica     (141)  SGCGWPAFFDGIPGAINRTADPDGR--------RIEIT-CA----
PF61417_10__Arabidopsis    (67)  AGCGWPAFFEGLPGAINRAPDPDGR--------RTEIT-CA----
PF61417_116__Brassica      (68)  SGCGWPAFFEGLPGAINRAPDPDGR--------STEIT-CA----
PF61417_12__Arabidopsis    (67)  SGCGWPAFFEGLPGAINRTPDPDGR--------RTEIT-CA----
PF61417_8__Arabidopsis    (106)  AGCGWPAFFEGIPGAITRTTDPDGR--------RIEIN-CA----
PF61417_118__Glycine      (134)  SGCGWPAFYEGIPGAINRNPDPDGM--------RTEIT-CA----
PF61417_122__Glycine      (134)  SGCGWPAFYEGIPGAINRNPDPDGM--------RTEIT-CA----
PF61417_126__Glycine       (66)  SGCGWPAFYEGIPGAINRNPDPDGM--------RTEIT-CA----
PF61417_132__Medicago     (121)  SGCGWPAFYEGVPGAINRHADPDGM--------RIEIT-CA----
PF61417_152__Solanum      (102)  SPCGWPSFYEGLPGAINRNPNPDGI--------RMEIT-CA----
 PF61417_84__Populus       (66)  SGCGWPAFYEGLPAAINRSPDPDGR--------RTEIT-CA----
PF61417_150__Solanum       (62)  SGCGWPAFFEGLPGTINRSPDPDGR--------RTEIT-CA----
PF61417_154__Triticum     (144)  SGCGWPAFYEGFPGAIKRTADPDGR--------RVEIT-CA----
PF61417_162__Triticum     (146)  SGCGWPAFYEGFPGAIKRTADPDGR--------RIEIT-CA----
PF61417_160__Triticum      (70)  SGCGWPAFYEGFPGAIKRTADPDGR--------RVEIT-CA----
 PF61417_52__Oryza        (157)  SGCGWPAFYEGFPGAIARTPDPDGR--------RIEIT-CA----
PF61417_142__Solanum       (66)  SGCGWPAFFEGLPGAINRTPDPDGR--------RVEIT-CA----
PF61417_148__Solanum      (129)  SGCGWPAFFEGLPGAINRTPDPDGR--------RTEIT-CA----
PF61417_120__Glycine      (262)  SGCGWPAFFEGFPGAINRTPDPDGR--------RTEIT-CA----
 PF61417_172__Zea          (37)  SGCGWPAFFEGLPGAINRTPDPDGR--------RVEIT-CA----
PF61417_158__Triticum      (66)  SGCGWPAFFEGLPGAIHRTPDPDGR--------RVEIT-CA----
 PF61417_48__Oryza         (69)  SGCGWPAFFEGLPGAINRTPDPDGR--------RVEIT-CA----
PF61417_138__Physcomitrella (135) SGCGWPAFFEGLPGAINETTDADGR--------RVEIT-CA----
PF61417_140__Physcomitrella  (70) SGCGWPAFFEGIPGAINETRDADGR--------RVEIT-CA----
  PF61417_2__Oryza        (132)  SGIYYYTPEQEKAARESLEKQQKLLNR----TIVTEIL-PAKRFY
PF61417_102__Medicago      (86)  SGTGWPSYYQPIGKNVKSKLDLSIIFM-----PRQEVL-CA----
                Consensus (271)  SG GWPAFY    I A I    D                 RTEIL CA
                                                                           motif 3
                                 motif 5                 motif 10
```

FIGURE 1 (continued)

```
                                        316                                                360
         PF61417_100__Zea    (173) HAEPEHQKFELKRKPFLLQLIGNLPEEELLTST--------LAAK
         PF61417_54__Oryza   (183) PAEPEHQKFELKRKPFLLQLIGNLPEEELLTST--------LAAK
    PF61417_6__Arabidopsis   (183) RAEPDHQKFELKQHPFLIQLIGNMVEEELERSA--------LATK
        PF61417_82__Populus   (85) PAEPEHQKFELKQNPFIRQLMGNLPEADLENSS--------LAAK
  PF61417_72__Physcomitrella (175) LAEAEHQKFELRRKPQLFQLLGDISDEDLTSSV--------LATK
    PF61417_24__Arabidopsis  (225) RAENYHQQYLAKGGRMG--LRQSAEKG--------------CKDP
    PF61417_28__Arabidopsis  (169) RAEEHHQQYLSKGGRFG--QGQSTAKG--------------CNDP
    PF61417_30__Arabidopsis  (169) RAEEHHQQYLSKGGRFG--LKQSTEKG--------------CNDP
         PF61417_32__Glycine (170) MAEEYHQQYLEKGGRFG--SKQSASKG--------------CNDP
         PF61417_34__Glycine (232) RAEEYHQQYLEKGGRFG--FKQSASKG--------------CNDP
          PF61417_42__linum  (171) RAEEYHQQYLAKGGRMG--LKQSAEKG--------------CNDP
        PF61417_80__Populus  (229) RAEEYHQQYLAKGGRFG--FKQSSEKG--------------CNDP
        PF61417_92__Populus  (231) RAEEYHQQYLAKGGRFG--FMQSAEKG--------------CNDP
         PF61417_58__Oryza   (230) RAEEYHQQYLAKGGR--FGFRQSAEKG--------------CNDP
       PF61417_98__Triticum  (230) KAEEYHQQYLAKGGR--FGFKQSTEKG--------------CNDP
       PF61417_46__Medicago  (161) RAEEYHQQYLEKGGGKGRGHGQSAQKG--------------CNHP
        PF61417_88__Populus  (157) RAEEYHQKYLEKGGG--RSAKQSAEKG--------------CNDP
        PF61417_90__Populus  (157) RAEEYHQQYLEKGGG--QGVKQSAEKG--------------CNDP
        PF61417_40__Hordeum  (154) PAEDYHQQYLEKGGQ-----SAKKR---------------CSDP
       PF61417_94__Triticum  (153) PAEDYHQQYLEKGGQ-----SAKKR---------------CSDP
       PF61417_44__Medicago  (169) RAEEYHQQYLEKGGRFG--FKQSAAKG--------------CNDP
       PF61417_96__Triticum  (153) AAEDYHQQYLHKGGQ-----SRQERGGPEPQSG--------CLRV
         PF61417_50__Oryza   (159) PAEEYHQRYLEKGGQ-----SAKKS---------------CNDP
  PF61417_64__Physcomitrella (136) LAEEYHQQYLEKGVSG---RKQSAAKM--------------CNDP
    PF61417_26__Arabidopsis  (185) KAEEYHQQYLVKGGMHG--NAQSPAKS--------------CKDP
  PF61417_66__Physcomitrella (234) RAEEYHQQYLAKGGRGG--NAQSPAKG--------------CTDP
  PF61417_68__Physcomitrella (239) RAENYHQQYLAKGGRMG--FKQSAEKG--------------CKDP
  PF61417_70__Physcomitrella (172) KAESYHQQYLSKGGRMG--SKQSAAKG--------------CKDS
    PF61417_60__Ostreococcus (184) YAEAYHQQYLAKPNARPVRIDGIDATTRGRVSI--------ENLV
        PF61417_36__Hordeum  (171) DAEQYHQQYLNKNPG-------GYECP--------------NHV
        PF61417_38__Hordeum  (153) DAEQYHQQYLSNNPR-------GYECP--------------NHV
    PF61417_62__Ostreococcus (177) VCLSNLFRDVLTTPLFSRAAKPGSRKYCSAEPTGVPMPTAWLKAN
        PF61417_76__Populus  (137) -RCGGHLGHVFDDG------PNRLLKY-----------------
        PF61417_78__Populus  (104) -RCGSHLGHVFPDG-----PPPTYERHCLNSVS--------LSFT
       PF61417_134__Medicago (179) -VCDAHLGHIFDDG-----PPPTGKRYCINSAS--------LKLK
        PF61417_124__Glycine (169) -VCDAHLGHVFDDG-----PPPTGKRFCINSAA--------LKLK
        PF61417_144__Solanum (116) -ACDAHLGHVFDDG-----PPPTGKRYCINSAS--------LKLK
        PF61417_146__Solanum (116) -ACDAHLGHVFDDG-----PPPTGKRYCINSAS--------LKLK
         PF61417_86__Populus (115) -ACDAHLGHVFDDG-----PPPTGKRYCINSAS--------LKLN
        PF61417_114__Brassica(167) -VCNAHLGHVFDDG-----PRPTGKRYCLNSAA--------LKLE
      PF61417_4__Arabidopsis (165) -VCNAHLGHVFDDG-----PRPTGKRYCLNSAA--------LKLN
        PF61417_128__Hordeum (115) -VCDAHLGHVFDDG-----PPPTGKRYCINSAS--------LKFK
        PF61417_130__Hordeum (166) -VCDAHLGHVFDDG-----PPPTGKRYCMQQRF--------SEV-
```

FIGURE 1 (continued)

```
PF61417_156__Triticum      (115) -VCDAHLGHVFDDG-----PPPTGKRYCINSAS--------LKFK
PF61417_164__Triticum      (115) -VCDAHLGHVFDDG-----PPPTGKRYCINSAS--------LKFK
PF61417_56__Oryza          (179) -VCDAHLGHVFDDG-----PRPTGKRYCINSAS--------LKLK
PF61417_166__Zea           (179) -TCDAHLGHVFDDG-----PPPTGKRYCINSAS--------LKLK
PF61417_170__Zea           (177) -TCDAHLGHVFDDG-----PPPTGKRYCINRYN--------FASV
PF61417_168__Zea           (111) -TCDAHLGHVFDDG-----PPPTGKRYCINSAS--------LKLK
PF61417_136__Physcomitrella (124) -VCDAHLGHVFDDG-----PRPTGKRYCINSAA--------IDLK
PF61417_74__Populus        (121) -QCGAHLGHVFPDG-----PSDTGLRYCMNSAS--------LEFE
PF61417_104__Arabidopsis    (96) ------IFFFFSFMTH---NYFSDKDCCIKQVL--------CL--
PF61417_20__Arabidopsis    (106) -ACDGHLGHVVKGEGF---PTATDERHCVNSVS--------LKFS
PF61417_110__Brassica      (106) -KCDGHLGHVFKGEGF---PTATDERHCVNSVS--------LKFN
PF61417_16__Arabidopsis    (106) -VCDGHLGHVFKGEGY---STPTDQRHCVNSVS--------LKFS
PF61417_18__Arabidopsis    (105) -VCDGHLGHVFKGEGY---STPTDQRHCVNSVS--------LKFA
PF61417_14__Arabidopsis    (115) -KCDGHLGHVLKNEGF---PTPTDERHCVNSVA--------LKFS
PF61417_106__Arabidopsis   (157) -------SHVLLVEDI---LVTFLKEKVSLLLP--------MSDT
PF61417_22__Arabidopsis    (164) -ACGGHLGHVFKGEGF---PTPTDERHCVNSIS--------LKFT
PF61417_108__Brassica      (100) -ACGGHLGHVFKGEGF---PTPTDERHCVNSIS--------LKFA
PF61417_112__Brassica      (173) -ACGGHLGHVFKGEGF---PTPTDERHCVNSVS--------LKFA
PF61417_10__Arabidopsis     (99) -VCDGHLGHVHKGEGY---STPTDERLCVNSVS--------INFN
PF61417_116__Brassica      (100) -VCDGHLGHVTKGEGY---DTPTDERHCVNSVS--------IIFN
PF61417_12__Arabidopsis     (99) -ACDGHLGHVFKGEGY---GNPTDERHCVNSVS--------ISFN
PF61417_8__Arabidopsis     (138) -TCGGHLGHVFKGEGF---ATPTDERHCVNSVS--------LKFT
PF61417_118__Glycine       (166) -ACGGHLGHVFKGEGF---PTPTNERHCVNSVS--------LKFA
PF61417_122__Glycine       (166) -ACGGHLGHVFKGEGF---PTPTNERHCVNSIS--------LKFA
PF61417_126__Glycine        (98) -ASGGHLCHVFIVRGF---SRPLTNAIVL----------------
PF61417_132__Medicago      (153) -ACGGHLGHVFKGEGF---PTPTNERHCVNSVS--------LKFA
PF61417_152__Solanum       (134) -ACGGHLGHVFKGEWF---RTPTNERHCVNSIS--------LKFK
PF61417_84__Populus         (98) -ACGGHLGHVFKGEGH---KTPTDERHCVNSIS--------IKFV
PF61417_150__Solanum        (94) -ACGGHLGHVFKGEGH---NTPTDERHCVNSVS--------VKFI
PF61417_154__Triticum      (176) -ACDGHLGHVFKGEGF---NTPTDERHCVNSIS--------LKFV
PF61417_162__Triticum      (178) -ACEGHLGHVFKGEGF---NTPTDERHCVNSIS--------LKFV
PF61417_160__Triticum      (102) -ACDGHLGHVFKGEGF---NTPTDERHCVNSIS--------LKFV
PF61417_52__Oryza          (189) -ACGGHLGHVFKGEGF---NTPTDERHCVNSIS--------LKFI
PF61417_142__Solanum        (98) -ACGGHLGHVFKGEGH---NTPTDERHCVNSIS--------VKFI
PF61417_148__Solanum       (161) -ACGGHLGHVFKGEGF---PTPTDERHCVNSVS--------LKFT
PF61417_120__Glycine       (294) -ACGGHLGHVFKGEGF---KTPTDERHCVNSIS--------VKFV
PF61417_172__Zea            (69) -ACGGHLGHVFKGEGF---KTPTDERHCVNSVS--------IKFS
PF61417_158__Triticum       (98) -SCGGHLGHVFKGESF---KTPTDEPHCVNSVS--------IKVY
PF61417_48__Oryza          (101) -ACGGHLGHVFKGEGF---KTPTDERHCVNSVS--------IKFT
PF61417_138__Physcomitrella (167) -ACGGHLGHVFRGEGF---PTPTDARHCVNSVS--------LKFT
PF61417_140__Physcomitrella (102) -ACGGHLGHVFKGEGF---PTPTDARHCVNSVS--------LKFT
PF61417_2__Oryza           (172) RAEEYHQQYLAKGGR--FGFRQSAEKG--------------CNDP
PF61417_102__Medicago      (121) -VCDAHLGHIFDDG-----PPPTGKRYCINSAS--------LKLK
Consensus                  (316) ACDGHLGHVFKGG      PT  RHCVNS S         LK
                                      motif 2
                                 motif 7    motif 11
```

FIGURE 1 (continued)

```
                                       361                                     401
       PF61417_100__Zea  (210) LNAYAAELCPANTQKRINSKIDEVTKKGWPILRDI------
       PF61417_54__Oryza (220) LNAYAAELCSPNTQNRINSKIDEIAKKGWPILRDI------
   PF61417_6__Arabidopsis (220) LNGYAAELCPPRIQKHIDSRVNEIIRKGWPVLRDI------
       PF61417_82__Populus (122) LNGYAAELCPPRIQKQINAKINDILRKGWPVLRDV------
 PF61417_72__Physcomitrella (212) LNGYAANLCPPNMKKLLDTKVSPFLLTRPNLQQILQF----
   PF61417_24__Arabidopsis (254) IRCYG-----------------------------------
   PF61417_28__Arabidopsis (198) IRCYG-----------------------------------
   PF61417_30__Arabidopsis (198) IRCYG-----------------------------------
       PF61417_32__Glycine (199) ILCYGYINMTRCFKQGVFLISIS-----------------
       PF61417_34__Glycine (261) IRCYG-----------------------------------
         PF61417_42__linum (200) IRCYG-----------------------------------
       PF61417_80__Populus (258) IRCYG-----------------------------------
       PF61417_92__Populus (260) IKCYG-----------------------------------
       PF61417_58__Oryza   (259) IRCYG-----------------------------------
     PF61417_98__Triticum  (259) IRCYG-----------------------------------
      PF61417_46__Medicago (192) IRCYG-----------------------------------
       PF61417_88__Populus (186) IRCYG-----------------------------------
       PF61417_90__Populus (186) IRCYG-----------------------------------
       PF61417_40__Hordeum (178) IRCYG-----------------------------------
     PF61417_94__Triticum  (177) IRCYG-----------------------------------
      PF61417_44__Medicago (198) IRCYG-----------------------------------
     PF61417_96__Triticum  (185) GKLTGPRVPRTGPKAYGMAGIGPVKPSFKGDTRS-------
       PF61417_50__Oryza   (183) IRCYG-----------------------------------
 PF61417_64__Physcomitrella (164) IRCYG-----------------------------------
   PF61417_26__Arabidopsis (214) IRCYG-----------------------------------
 PF61417_66__Physcomitrella (263) IRCYG-----------------------------------
 PF61417_68__Physcomitrella (268) IRCYG-----------------------------------
 PF61417_70__Physcomitrella (201) IRCYG-----------------------------------
   PF61417_60__Ostreococcus (221) SRTHD-----------------------------------
       PF61417_36__Hordeum (194) LRKFPPLL--------------------------------
       PF61417_38__Hordeum (176) LREFPPLL--------------------------------
   PF61417_62__Ostreococcus (222) GGKFGPGFWAKYGPKPGCTIGVPDAQVSLDAALEAK-----
       PF61417_76__Populus (157) -----------------------------------------
       PF61417_78__Populus (135) GNGEPWPDPLQRGGAEAGVAG--------------------
      PF61417_134__Medicago (210) PRK--------------------------------------
       PF61417_124__Glycine (200) PKQ--------------------------------------
       PF61417_144__Solanum (147) PK---------------------------------------
       PF61417_146__Solanum (147) AK---------------------------------------
       PF61417_86__Populus  (146) PK---------------------------------------
      PF61417_114__Brassica (198) SLERTRE----------------------------------
    PF61417_4__Arabidopsis (196) ALEKTRD----------------------------------
       PF61417_128__Hordeum (146) PQ---------------------------------------
       PF61417_130__Hordeum (196) -----------------------------------------
```

FIGURE 1 (continued)

```
        PF61417_156__Triticum  (146) PQ----------------------------------------
        PF61417_164__Triticum  (146) PQ----------------------------------------
          PF61417_56__Oryza    (210) KTQ---------------------------------------
           PF61417_166__Zea    (210) PQ----------------------------------------
           PF61417_170__Zea    (208) YSHITPLHVLSNSKVWSAHVSVVVIGLGIVSLRVLLHFPLQ
           PF61417_168__Zea    (142) PQ----------------------------------------
    PF61417_136__Physcomitrella (155) AEKQEERN----------------------------------
         PF61417_74__Populus   (152) PPKA--------------------------------------
      PF61417_104__Arabidopsis (122) ------------------------------------------
       PF61417_20__Arabidopsis (139) EISSQ-------------------------------------
        PF61417_110__Brassica  (139) SSETSS------------------------------------
       PF61417_16__Arabidopsis (139) SAGSSQ------------------------------------
       PF61417_18__Arabidopsis (138) SADSSK------------------------------------
       PF61417_14__Arabidopsis (148) SAITSQ------------------------------------
      PF61417_106__Arabidopsis (184) V-----------------------------------------
       PF61417_22__Arabidopsis (197) PENPTL------------------------------------
        PF61417_108__Brassica  (133) PGNQDL------------------------------------
        PF61417_112__Brassica  (206) PGNAAL------------------------------------
       PF61417_10__Arabidopsis (132) PAKPSSIT----------------------------------
        PF61417_116__Brassica  (133) PQKPPEEAED--------------------------------
       PF61417_12__Arabidopsis (132) PAKSSSII----------------------------------
        PF61417_8__Arabidopsis (171) PAASSL------------------------------------
         PF61417_118__Glycine  (199) PANSYS------------------------------------
         PF61417_122__Glycine  (199) PANS--------------------------------------
         PF61417_126__Glycine  (123) ------------------------------------------
         PF61417_132__Medicago (186) PANS--------------------------------------
         PF61417_152__Solanum  (167) PPQFS-------------------------------------
          PF61417_84__Populus  (131) SSQ---------------------------------------
         PF61417_150__Solanum  (127) PANTSSVLL---------------------------------
         PF61417_154__Triticum (209) PASEEAS-----------------------------------
         PF61417_162__Triticum (211) PASEEAS-----------------------------------
         PF61417_160__Triticum (135) PASEEAS-----------------------------------
           PF61417_52__Oryza   (222) PASEDSKL----------------------------------
         PF61417_142__Solanum  (131) PANTSSVLL---------------------------------
         PF61417_148__Solanum  (194) PANS--------------------------------------
         PF61417_120__Glycine  (327) PGSATFSI----------------------------------
            PF61417_172__Zea   (102) PGSS--------------------------------------
         PF61417_158__Triticum (131) SCPPPDSSSWSHWDELPQVPKTREKQLWI-------------
           PF61417_48__Oryza   (134) PAS---------------------------------------
    PF61417_138__Physcomitrella (200) PANKS-------------------------------------
    PF61417_140__Physcomitrella (135) PANMA-------------------------------------
            PF61417_2__Oryza   (201) IRCYG-------------------------------------
         PF61417_102__Medicago (152) PRK---------------------------------------
                     Consensus (361)
```

|                        |      | 1                                                  50 |
|-----------------------:|------|----------------------------------------------------|
|              AT1G74030 | (1)  | -------------------------------------------------- |
|        Pt scaff_XII.488 | (1)  | -------------------------------------------------- |
|     Os LOC_Os09g20820.1 | (1)  | -------------------------------------------------- |
|           Zm_enolase_2 | (1)  | MAREPHLPPPIRRLHQPRLIQKIYSPKPLANATSPPPPDPAKRHDDLYLY |
|              AT2G29560 | (1)  | -------------------------------------------------- |
|         Pt scaff_IX.1243 | (1)  | -------------------------------------------------- |
|     Os LOC_Os03g15950.1 | (1)  | -------------------------------------------------- |
|             Ot enolase | (1)  | -------------------------------------------------- |
|            AT2G36530.1 | (1)  | -------------------------------------------------- |
|      Gm enolase Hyseq_2 | (1)  | -------------------------------------------------- |
|         Pt scaff_28.296 | (1)  | -------------------------------------------------- |
|         Gm enolase Hyseq | (1)  | -------------------------------------------------- |
|         Pt scaff_XV.1093 | (1)  | -------------------------------------------------- |
|             enolase TM | (1)  | -------------------------------------------------- |
|       Os LOC_Os10g08550 | (1)  | -------------------------------------------------- |
|             Hv enolase | (1)  | -------------------------------------------------- |
|            Zm enolase_1 | (1)  | -------------------------------------------------- |
|     Os LOC_Os03g14450.1 | (1)  | -------------------------------------------------- |
|     Os LOC_Os03g14450.2 | (1)  | -------------------------------------------------- |
|     Os LOC_Os06g04510.1 | (1)  | -------------------------------------------------- |
|            Zm enolase_3 | (1)  | -------------------------------------------------- |
|              Consensus | (1)  | |

|                        |      | 51                                                100 |
|-----------------------:|------|----------------------------------------------------|
|              AT1G74030 | (1)  | MALTTKPHHLQRSFLSPSRVSGER------------------------Y |
|        Pt scaff_XII.488 | (1)  | MALATQPATNFFNKKNPLLNSFSTK------------------------Q |
|     Os LOC_Os09g20820.1 | (1)  | ------MAHRLLLPTNPLLPP---------------------GTGTAT |
|           Zm_enolase_2 | (51) | LAATVTVARRHISKPSPRPPPRLATLRLRHMAHPHLVLPSPKSLLPAAAT |
|              AT2G29560 | (1)  | -------------------------------MSVQEYLDKHMLSRKIE |
|         Pt scaff_IX.1243 | (1)  | -------------------------------MSVQEYLDKHVLSRKIE |
|     Os LOC_Os03g15950.1 | (1)  | -------------------------------MSVQEYLEKHLLSRKIE |
|             Ot enolase | (1)  | -------------------------------MSVQEYIEKHDLTRKVE |
|            AT2G36530.1 | (1)  | -------------------------------------------------- |
|      Gm enolase Hyseq_2 | (1)  | -------------------------------------------------- |
|         Pt scaff_28.296 | (1)  | -------------------------------------------------- |
|         Gm enolase Hyseq | (1)  | -------------------------------------------------- |
|         Pt scaff_XV.1093 | (1)  | -------------------------------------------------- |
|             enolase TM | (1)  | -------------------------------------------------- |
|       Os LOC_Os10g08550 | (1)  | ----------------------------------------MSRIHRNPT |
|             Hv enolase | (1)  | -------------------------------------------------- |
|            Zm enolase_1 | (1)  | -------------------------------------------------- |
|     Os LOC_Os03g14450.1 | (1)  | -------------------------------------------------- |
|     Os LOC_Os03g14450.2 | (1)  | -------------------------------------------------- |
|     Os LOC_Os06g04510.1 | (1)  | -------------------------------------------------- |
|            Zm enolase_3 | (1)  | -------------------------------------------------- |
|              Consensus | (51) | |

FIGURE 3

```
                              101                                                150
            AT1G74030    (26)  LESAPSCLRFRRSG----VQCSVVAKECRVKGVKARQIIDSRGNPTVEVD
       Pt scaff_XII.488  (27)  PKTSTRSLVIRNSVTVAPPSTVRIAKECKVKSVKARQIIDSRGNPTVEVD
      Os LOC_Os09g20820.1 (22) PRRRPVAATVRAALATSAEEARAATGAEVVRSIRARQIVDSRGNPTVEVD
           Zm_enolase_2 (101)  PSRR--AVAIRAAISTALSPAKAAAGAEAVRSIRARQIVDSRGNPTVEVD
            AT2G29560    (18)  DAVNAAVRAKTSDPVLFIANHLKKAVSSVITKVKARQILDSRGIPTVEVD
        Pt scaff_IX.1243 (18)  DAVNAAVRAKTPDPVLFISNHMRKAVPSVITKIKGRQILDSRGIPTVEVD
      Os LOC_Os03g15950.1 (18) EAVNAAVRAKAPDPVLFISNHMRRAAPAVITSVRARQILDGRGEPAVEVS
             Ot enolase  (18)  EALNAAVKAKADEPLAFVSEYMKKRTAPAITKVVGRQIFDSRGNPTVEAD
            AT2G36530.1   (1)  -----------------------MATITVVKARQIFDSRGNPTVEVD
        Gm enolase Hyseq_2 (1) -----------------------MATIVSIKARQIFDSRGNPTVEVD
         Pt scaff_28.296  (1)  -----------------------MTITIVSVKARQIFDSRGNPTVEAD
         Gm enolase Hyseq (1)  -----------------------MATIKAVKARQIFDSRGNPTVEVD
         Pt scaff_XV.1093 (1)  -----------------------MVTIKAVKARQIFDSRGNPTVEAD
             enolase TM   (1)  -----------------------MAATIVSVKARQIFDSRGNPTVEVD
       Os LOC_Os10g08550 (10)  LLAPTPSPSSIPPLLEPSRSSPPPPMAATIVSVKARQIFDSRGNPTVEVD
              Hv enolase  (1)  -----------------------MAATIQSVKARQIFDSRGNPTVEVD
            Zm enolase_1  (1)  -----------------------MAATIQSVKARQIFDSRGNPTVEVD
      Os LOC_Os03g14450.1 (1)  -----------------------MAATIQSVKARQIFDSRGNPTVEVD
      Os LOC_Os03g14450.2 (1)  --------------------------------------------------
      Os LOC_Os06g04510.1 (1)  -----------------------MAVTIQSVKARQIFDSRGNPTVEVD
            Zm enolase_3  (1)  -----------------------MAVTITWVKARQIFDSRGNPTVEVD
              Consensus (101)                          AATI SVKARQIFDSRGNPTVEVD 151                                                200
            AT1G74030    (72)  LITDD--LYRSAVPSGASTGIYEALELRDGDKSVYGGKGVLQAIKNINEL
       Pt scaff_XII.488  (77)  LVTDDQ-LYRSAVPSGASTGIYEALELRDGDKSVYGGKGVLSAVQNVNNF
      Os LOC_Os09g20820.1 (72) LVAGDGRLHRSAVPSGASTGIYEALELRDGDGAAYGGKGVLNAVRNINEV
           Zm_enolase_2 (149)  LVAGDGRLHRSAVPSGASTGIYEALELRDGDKAVYGGKGVLQAVRNINEV
            AT2G29560    (68)  LHTNKG-VFRASVPSGDSSGTYEAIELRDGDKGMYLGNSVAKAVKNINEK
        Pt scaff_IX.1243 (68)  LFTNKG-SFRASVPSGHVTGMYEAVELRDGDKGMYLGNSVTRAVKNINEK
      Os LOC_Os03g15950.1 (68) LHTNKA-VHRASAAAADAPEGAAADAVRDAEKRKLLARAVADAVRVINDK
             Ot enolase (68)   VYTHKG-MFRAMVPSGASTGIYEAVELRDGGNTYMG-KGVQQAVKNLNEI
            AT2G36530.1  (25)  IHTSNGIKVTAAVPSGASTGIYEALELRDGGSDYLG-KGVSKAVGNVNNI
        Gm enolase Hyseq_2 (25) LTCSDGTFARAAVPSGASTGIYEALELRDGGSDYLG-KGVSKAVDNVNTV
         Pt scaff_28.296 (26)  VTTSDGVLSRAAVPSGASTGVYEALELRDGGSDYLG-KGVSKAVGNVNTI
         Gm enolase Hyseq (25) VILSDGSFHRAAVPSGASTGVYEALELRDGGSDYLG-KGVLKAVENVNSI
         Pt scaff_XV.1093 (25) ILLSDGSYARAAVPSGASTGVYEALELRDGGSDYLG-KGVLKAVGNVNSI
             enolase TM  (26)  VCCSDGTFARAAVPSGASTGVYEALELRDGGSDYLG-KGVSKAVDNVNSV
       Os LOC_Os10g08550 (60)  VCCSDGTFARAAVPSGASTGVYEALELRDGGSDYLG-KGVSKAVDNVNSV
              Hv enolase (26)  VCCSDGTFARAAVPSGASTGVYEALELRDGGSDYLG-KGVSKAVDNVNSI
            Zm enolase_1 (26)  VFCSDGTFARAAVPSGASTGVYEALELRDGGSDYLG-KGVSKAVNNVNSV
      Os LOC_Os03g14450.1 (26) ICCSDGTFARAAVPSGASTGVYEALELRDGGSDYLG-KGVLKAVDNVNSI
      Os LOC_Os03g14450.2 (1)  -------------------------MSAFIFTCR-LLFQQAVDNVNSI
      Os LOC_Os06g04510.1 (26) VGLSDGSFARGAVPSGASTGIYEALELRDGGSDYLG-KGVLKAVSNVNTI
            Zm enolase_3 (26)  VGLSDGSYARGAVPSGASTGIYEALELRDGGSDYLG-KGVLKAVSNVNNI
              Consensus (151)  V  SDG    RAAVPSGASTGIYEALELRDGGSDYLG KGV KAV NVNSI
```

FIGURE 3 (continued)

```
                              201                                            250
         AT1G74030      (120) VAPKLIGVDVRNQADVD-ALMLELDGTPNKS-----KLGANAILGVSLSV
     Pt scaff_XII.488  (126) LGPKLLGVDVRNQADVD-AIMLDIDGTPNKA-----KLGANAILGVSLSV
  Os LOC_Os09g20820.1  (122) IAPKLVGVDVRNQSDVD-AIMLDIDGTPNKS-----KLGANAILGVSLSV
         Zm_enolase_2  (199) IAPKLIGVDVRNQSDVD-AVMLDIDGTQNKS-----KLGANAILGVSLSV
           AT2G29560   (117) ISEALIGMDPKLQGQID-QAMIDLDKTEKKS-----ELGANAILAVSIAA
     Pt scaff_IX.1243  (117) ISEALIGMDPTLQSQID-QAMIDLDKTEKKG-----ELGANAMLAVSIAA
  Os LOC_Os03g15950.1  (117) VSEALVGMDPQQQSQID-QAIMDLDKAHHKA-----EIGVNSMLAVSIAA
           Ot enolase  (116) IAPALVGKDPREQKALDDFMCKELDGTENKG-----KLGANAILAVSMAI
         AT2G36530.1    (74) IGPALIGKDPTQQTAIDNFMVHELDGTQNEWGWCKQKLGANAILAVSLAV
    Gm enolase Hyseq_2  (74) IGPALIGKDPTEQTAIDNLMVQQLDGTVNEWGWCKQKLGANAILAVSLAV
      Pt scaff_28.296   (75) IGPALIGKDPTEQVAIDNLMVQQLDGTVNEWGWCKQKLGANAILAVSLAV
       Gm enolase Hyseq (74) IAPALLGKDPTKQTEIDNFMVQQLDGTVNEWGWCKQKLGANAILAVSLAV
      Pt scaff_XV.1093  (74) IGPALIGKDPTEQVQIDNFMVQELDGTVNEWGWCKQKLGANAILAVSLAV
           enolase TM   (75) IAPALIGKDPTSQAELDNFMVQQLDGTKNEWGWCKQKLGANAILAVSLAI
    Os LOC_Os10g08550  (109) IAPALIGKDPTSQAELDNFMVQQLDGTKNEWGWCKQKLGANAILAVSLAI
           Hv enolase   (75) IAPALIGKDPTAQTELDNFMVQQLDGTKNEWGWCKQKLGANAILAVSLAV
           Zm enolase_1 (75) IGPALIGKDPTAQTEIDNFMVQQLDGTKNEWGWCKQKLGANAILAVSLAV
    Os LOC_Os03g14450.1 (75) IGPALIGKDPTEQTVIDNFMVQQLDGTKNEWGWCKQKLGANAILAVSLAL
    Os LOC_Os03g14450.2 (23) IGPALIGKDPTEQTVIDNFMVQQLDGTKNEWGWCKQKLGANAILAVSLAL
    Os LOC_Os06g04510.1 (75) IGPALIGKDPTEQVDIDNFMVQQLDGTSNNWGWCKQKLGANAILAVSLAV
         Zm enolase_3   (75) IGPAIVGKDPTEQVEIDNFMVQQLDGTSNEWGWCKQKLGANAILAVSLAV
            Consensus  (201) IGPALIGKDPT QTEIDNFMVQQLDGT NEWGWCKQKLGANAILAVSLAV 251                                            300
         AT1G74030      (164) CRAGAGAKGV--PLYKHIQETSGTKELVMPVPAFNVINGGSHAGNSLAMQ
     Pt scaff_XII.488  (170) CRAGAGAKGV--PLYKHIQEISGTKELVMPVPAFNVINGGSHAGNNLAMQ
  Os LOC_Os09g20820.1  (166) CRAGAGAKEV--PLYKHIQELAGTKELVMPVPAFNVINGGSHAGNNLAMQ
         Zm_enolase_2  (243) CRAGAGAKGV--PLYKHIQELAGIKELVMPVPAFNVINGGSHAGNNLAMQ
           AT2G29560   (161) CKAGAAEKEV--PLCKHLSDLSGRANMVLPVPAFTVLSGGKHASNTFAIQ
     Pt scaff_IX.1243  (161) CKAGAAEKEA-VPLYKHISDLSSKTNPTLPVPAFTVISGGKHAGNNLAIK
  Os LOC_Os03g15950.1  (161) CKAGAAEKEV--PLYKHIAELVGKSATTLPIPAITVINGGTHAGNSLPIQ
           Ot enolase  (161) AKAGAAEKDV--PLYKHLADLAGNGKLVLPVPAFNVINGGSHAGNKLAMQ
         AT2G36530.1   (124) CKAGAVVSGI--PLYKHIANLAGNPKIVLPVPAFNVINGGSHAGNKLAMQ
    Gm enolase Hyseq_2 (124) CKAGASVLKI--PLYKHIANIAGNKKLVLPVPAFNVINGGSHAGNKLAMQ
      Pt scaff_28.296  (125) CKAGAHAKGI--PLYKHIANLAGNKNLVLPVPAFNVINGGSHAGNKLAMQ
       Gm enolase Hyseq(124) CKAGAAVKKI--PLYKHIANLAGNKTLVLPVPSFNVINGGSHAGNKLAMQ
      Pt scaff_XV.1093 (124) CKAGAMVKKI--PLYQHIANLAGNKTLVLPVPAFNVINGGSHAGNKLAMQ
           enolase TM  (125) CKAGAIIKKI--PLYQHIANLAGNQLVLPVPAFNVINGGSHAGNKLAMQ
    Os LOC_Os10g08550  (159) CKAGAIIKKI--PLYQHIANLAGNQLVLPVPAFNVINGGSHAGNKLAMQ
           Hv enolase  (125) CKAGASVKKI--PLYQHIANLAGNQLVLPVPAFNVINGGSHAGNKLAMQ
           Zm enolase_1(125) CKAGASIKRI--PLYQHIANLAGNQLVLPVPAFNVINGGSHAGNKLAMQ
    Os LOC_Os03g14450.1(125) CKAGAIIKKI--PLYQHIANLAGNQLVLPVPAFNVINGGSHAGNKLAMQ
    Os LOC_Os03g14450.2 (73) CKAGAIIKKI--PLYQHIANLAGNQLVLPVPAFNVINGGSHAGNKLAMQ
    Os LOC_Os06g04510.1(125) CKAGAMVKKI--PLYQHIANLAGNKTLVLPVPAFNVINGGSHAGNKLAMQ
         Zm enolase_3  (125) CKAGAMVKKI--PLYQHIANLAGNKTLVLPVPAFNVINGGSHAGNKLAMQ
            Consensus  (251) CKAGA VKKI   PLYKHIANLAGNK LVLPVPAFNVINGGSHAGNKLAMQ
```

FIGURE 3 (continued)

```
                              301                                              350
         AT1G74030     (212)  -----------------------EFMILPVGATSFSEAFQMGSEVY
   Pt_scaff_XII.488    (218)  -----------------------EFMILPVGATNFAEALRMGSEVY
  Os_LOC_Os09g20820.1  (214)  -----------------------EFMLLPVGASSFSEALRMGSEVY
        Zm_enolase_2   (291)  -----------------------EFMILPVGATTFAEALRMGSEVY
           AT2G29560   (209)  -----------------------EIMILPIGASRFEEALQWGSETY
    Pt_scaff_IX.1243   (210)  -----------------------EIMILPIGASTFEEALQMGSETY
  Os_LOC_Os03g15950.1  (209)  -----------------------EIMILPVGAKNFEEAMQMGSETY
          Ot enolase   (209)  -----------------------EFMILPVGAKTFKEAMQMGSEVY
         AT2G36530.1   (172)  -----------------------EFMILPVGAASFKEAMKMGVEVY
    Gm enolase Hyseq_2 (172)  -----------------------EFMVLPVGASSFKEAMKMGVEVY
     Pt_scaff_28.296   (173)  ARILIFHLIYFSRMLLEFEFLTLFHLQEFMILPTGASSFKEAMKMGAEVY
      Gm enolase Hyseq (172)  -----------------------EFMILPVGASSFKEAMKMGVEVY
    Pt_scaff_XV.1093   (172)  -----------------------EFMILPVGASSFKEAMKMGVEVY
          enolase TM   (173)  -----------------------EFMILPTGAASFKEAMKMGVEVY
   Os_LOC_Os10g08550   (207)  -----------------------EFMILPTGAASFKEAMKMGVEVY
          Hv enolase   (173)  -----------------------EFMILPTGAASFKEAMKMGVEVY
        Zm enolase_1   (173)  -----------------------EFMILPTGAASFKEAMKMGVEVY
  Os_LOC_Os03g14450.1  (173)  -----------------------EFMILPTGASSFKEAMKMGVEVY
  Os_LOC_Os03g14450.2  (121)  -----------------------EFMILPTGASSFKEAMKMGVEVY
  Os_LOC_Os06g04510.1  (173)  -----------------------EFMILPTGASSFKEAMKMGVEVY
        Zm enolase_3   (173)  -----------------------EFMILPTGASSFKEAMKMGVEVY
           Consensus   (301)                         EFMILPVGASSFKEAMKMGVEVY 351                                              400
         AT1G74030     (235)  HTLKGIIKTKYGQDACNVGDEGGFAPNVQ---------------------
   Pt_scaff_XII.488    (241)  HTLKKIIEKKYGQDACNVGDEGGFAPNVQ---------------------
  Os_LOC_Os09g20820.1  (237)  HALKGIIKAKYGQDACNVGDEGGFAPNVQ---------------------
        Zm_enolase_2   (314)  HVLKSIIKSKYGQDACNVGDEGGFAPNVQ---------------------
           AT2G29560   (232)  HHLKAVISEKNGGLGCNVGEDGGLAPDIS---------------------
    Pt_scaff_IX.1243   (233)  HHLKAVIKEKYGEQGCNVGEDGGFSPNLSRQDSYNLLSAPLKESNICSKL
  Os_LOC_Os03g15950.1  (232)  HHLKDIILEKYGSNSCNIGDDGGFAPNIS---------------------
          Ot enolase   (232)  HNLKSVIKKKYGQDACNVGDEGGFAPNIQ---------------------
         AT2G36530.1   (195)  HHLKSVIKKKYGQDATNVGDEGGFAPNIQ---------------------
    Gm enolase Hyseq_2 (195)  HNLKSVIKKKYGQDAVNVGDEGGFAPNIQ---------------------
     Pt_scaff_28.296   (223)  HHLKSVIKKKYGQDATNVGDEGGFAPNIQ---------------------
      Gm enolase Hyseq (195)  HHLKAVIKKKYGQDATNVGDEGGFAPNIQ---------------------
    Pt_scaff_XV.1093   (195)  HHLKSVIKKKYGQDATNVGDEGGFAPNIQ---------------------
          enolase TM   (196)  HNLKSVIKKKYGQDATNVGDEGGFAPNIQ---------------------
   Os_LOC_Os10g08550   (230)  HNLKSVIKKKYGQDATNVGDEGGFAPNIQ---------------------
          Hv enolase   (196)  HNLKSVIKKKYGQDATNVGDEGGFAPNIQ---------------------
        Zm enolase_1   (196)  HHLKSVIKKKYGQDATNVGDEGGFAPNIQ---------------------
  Os_LOC_Os03g14450.1  (196)  HNLKSVIKKKYGQDATNVGDEGGFAPNIQ---------------------
  Os_LOC_Os03g14450.2  (144)  HNLKSVIKKKYGQDATNVGDEGGFAPNIQ---------------------
  Os_LOC_Os06g04510.1  (196)  HHLKSIIKKKYGQDATNVGDEGGFAPNIQ---------------------
        Zm enolase_3   (196)  HNLKSIIKKKYGQDATNVGDEGGFAPNIQ---------------------
           Consensus   (351)  H LKSVIKKKYGQDATNVGDEGGFAPNIQ
```

FIGURE 3 (continued)

```
                               401                                           450
         AT1G74030       (264) ----------DNREGLVLLIDAIEKAGYTGKIKIGMDVAASEFF-MKDG
    Pt scaff_XII.488    (270) ----------DNREGLVLLMDAIEKAGYTGKIKIGMDVAASEF--LKDG
   Os LOC_Os09g20820.1  (266) ----------DNREGLVLLMDAIEKAGYSGKIKIGMDVAASEFL-TKDG
         Zm_enolase_2   (343) ----------DNREGLILLMDAIEKAGYTGMIKIGMDVAASEFL-TKDG
         AT2G29560      (261) ----------SLKEGLELVKEAINRTGYNDKIKIAIDIAATNFC--LGT
    Pt scaff_IX.1243    (283) IWGSYLIISIGSVQEGLNLVKEAISRTGYSEKIKMAIDVAATTFC--IGT
   Os LOC_Os03g15950.1  (261) ----------SITEGLDLVIEAINRAGYNGRIKLAIDVAATDFC--MGN
          Ot enolase    (261) ----------DNKEGLDLLVEAIEKAGYTGKMKIGMDVAASEFL-TEDK
         AT2G36530.1    (224) ----------ENKEGLELLKTAIEKAGYTGKVVIGMDVAASEFY-SEDK
    Gm enolase Hyseq_2  (224) ----------ENKEGLELLKTAIAKAGYTGKVVIGMDVAASEFY-KEDK
      Pt scaff_28.296   (252) ----------DNQEGLELLKTAIAKAGYTGKVVIGMDVAASEFY-GADK
      Gm enolase Hyseq  (224) ----------ENQEGLELLKTAIAKAGYTGKVVIGMDVAASEFYDNKDK
      Pt scaff_XV.1093  (224) ----------ENKEGLELLKTAIAKAGYTGKVVIGMDVAASEFYNDKDK
          enolase TM    (225) ----------ENKEGLELLKTAIEKAGYTGKVVIGMDVAASEFYNDKDK
   Os LOC_Os10g08550    (259) ----------ENKEGLELLKTAIEKAGYTGKVVIGMDVAASEFYNDKDK
          Hv enolase    (225) ----------ENKEGLELLKTAIEKAGYTGKVVIGMDVAASEFYNDKDK
         Zm enolase_1   (225) ----------ENKEGLELLKTAIEKAGYTGKVVIGMDVAASEFYSDKDQ
   Os LOC_Os03g14450.1  (225) ----------ENKEGLELLKTAIEKAGYTGKVVIGMDVAASEFY-TEDQ
   Os LOC_Os03g14450.2  (173) ----------ENKEGLELLKTAIEKAGYTGKVVIGMDVAASEFY-TEDQ
   Os LOC_Os06g04510.1  (225) ----------ENKEGLELLKAAIAKAGYTGKVVIGMDVAASEFYSEKDK
         Zm enolase_3   (225) ----------ENKEGLELLKAAIEKAGYTGKVVIGMDVAASEFFGEKDK
           Consensus    (401)           ENKEGLELLKTAIEKAGYTGKVVIGMDVAASEFY KDK 451                                           500
         AT1G74030       (302) RYDLNFKKQPNDGAHVLSAESLADLYREFIKDFPIVSIEDPFDQDDWSSW
    Pt scaff_XII.488    (307) KYDLNFKNQPNDGAHVLSAQSLGDLYKDFVKEFPIVSIEDPFDQDDWNSW
   Os LOC_Os09g20820.1  (304) SYDLNFKNQPNDGAHVLSAQRLCDLYKEFVKDFPIVSIEDPFDQDDWSSW
         Zm_enolase_2   (381) NYDLNFKNQPNDGVHVLSAQHLGDLYRDFVKDFPIVSIEDPFDQDDWSSW
         AT2G29560      (298) KYDLDIKSPNKSGQNFKSAEDMIDMYKEICNDYPIVSIEDPFDKEDWEHT
    Pt scaff_IX.1243    (331) KYDLDYKFQNKSGQNFKSGDDMIKMYEELCAAYPIVSIEDPFDREDWEHV
   Os LOC_Os03g15950.1  (298) KYDMEFKFAEKSGQGFKTADDLIEIYSQLCSEYPLVSIEQPFDKDDWEHS
          Ot enolase    (299) QYDLDFKTENNDGSMKKTGAQMIDLYQEFINEYPMISIEDPFDQDDAENT
         AT2G36530.1    (262) TYDLNFKEENNNGSQKISGDALKDLYKSFVAEYPIVSIEDPFDQDDWEHY
    Gm enolase Hyseq_2  (262) TYDLNFKEDNNDGSQRISGDALKDLYKSFVSEYPIVSIEDPFDQDDWEHY
      Pt scaff_28.296   (290) TYDLNFKEENNDGSKKITGDALKDLYKSFVSEYPIVSIEDPFDQDDWEHY
      Gm enolase Hyseq  (263) TYDLNFKEENNDGSQKISGDSLKNVYKSYVTDYPIVSIEDPFDQDDWEHY
      Pt scaff_XV.1093  (263) TYDLNFKEENNDGSQKISGDSLKNVYKSFVADYPIVSIEDPFDQDDWEHY
          enolase TM    (264) TYDLNFKEENNDGSQKISGDSLKNVYKSFVSEYPIVSIEDPFDQDDWEHY
   Os LOC_Os10g08550    (298) TYDLNFKEENNDGSQKISGDSLKNVYKSFVSEYPIVSIEDPFDQDDWEHY
          Hv enolase    (264) TYDLNFKEENNDGSQKISGDSLKNVYKSFVSEYPIVSIEDPFDQDDWVHY
         Zm enolase_1   (264) TYDLNFKEENNDGSQKISGDSLKNVYKSFVSEYPIVSIEDPFDQDDWVHY
   Os LOC_Os03g14450.1  (263) TYDLNFKEENNDGSQKISGDSLKNVYKSFVSEYPIVSIEDPFDQDDWVHY
   Os LOC_Os03g14450.2  (211) TYDLNFKEENNDGSQKISGDSLKNVYKSFVSEYPIVSIEDPFDQDDWVHY
   Os LOC_Os06g04510.1  (264) TYDLNFKEDNNDGSHKISGDSLKDVYKSFVSEYPIVSIEDPFDQDDWATY
         Zm enolase_3   (264) TYDLNFKEENNDGSNKISGDSLKDLYKSFVSEYPIESIEDPFDQDDWSTY
           Consensus    (451) TYDLNFKEENNDGSQKISGDSLKDLYKSFVSEYPIVSIEDPFDQDDWEHY
```

FIGURE 3 (continued)

```
                              501                                           550
         AT1G74030     (352)  ASLQSSV-----------------------DIQLVGDDLLVTNPKRIAE
    Pt_scaff_XII.488   (357)  ASLQSSV-----------------------DIQIVGDDLLVTNPKRIAE
   Os_LOC_Os09g20820.1 (354)  ASLQSSV-----------------------NIQIVGDDLLVTNPKRIAE
         Zm_enolase_2  (431)  ASLQSSV-----------------------GIQIVGDDLLVTNPKRIAD
         AT2G29560     (348)  KYFSSLGIC---------------------QVVGDDLLMSNSKRVER
    Pt_scaff_IX.1243   (381)  KRFSDLGLCQVCSLHLGLSFVYIHTRSCKRICSQVVGDDLLMSNHKRIER
   Os_LOC_Os03g15950.1 (348)  KKFTTLELC---------------------QVVGDDLLMSDPERIKR
            Ot_enolase (349)  AALTAKG-----------------------NCQIVGDDLLVTNPKRVQA
         AT2G36530.1   (312)  AKMTTECGT---------------------EVQIVGDDLLVTNPKRVAK
     Gm_enolase_Hyseq_2(312)  AKLTAEVGA---------------------NVQIVGDDLLVTNPKRVQK
        Pt_scaff_28.296(340)  AKLTAEIGE---------------------KVQIVGDDLLVTNPKRVEK
       Gm_enolase_Hyseq(313)  AKLTAEVGQ---------------------QVQIVGDDLLVTNPKRVEK
       Pt_scaff_XV.1093(313)  AKMTGEVGE---------------------QVQIVGDDLLVTNPKRVEK
            enolase_TM (314)  AKMTAEIGE---------------------QVQIVGDDLLVTNPTRVAK
       Os_LOC_Os10g08550(348) AKMTAEIGE---------------------QVQIVGDDLLVTNPTRVAK
            Hv_enolase (314)  AKMTEECGE---------------------QVQIVGDDLLVTNPTRVAK
         Zm_enolase_1  (314)  AKMTEEIGE---------------------QVQIVGDDLLVTNPTRVAK
   Os_LOC_Os03g14450.1 (313)  AKMTEEIGD---------------------QVQIVGDDLLVTNPTRVAK
   Os_LOC_Os03g14450.2 (261)  AKMTEEIGD---------------------QVQIVGDDLLVTNPTRVAK
   Os_LOC_Os06g04510.1 (314)  AKLTDEIGQ---------------------QVQIVGDDLLVTNPTRVAK
         Zm_enolase_3  (314)  AKLTDEIGQ---------------------KVQIVGDDLLVTNPTRVAK
             Consensus (501)  AKLTAEIG                      QVQIVGDDLLVTNPKRVAK 551                                           600
         AT1G74030     (378)  AIKKQSCNALLLK-----------VNQIGTVTESIQAALDSKAAGWGVM
    Pt_scaff_XII.488   (383)  AIQKKACNGLLLKASIKSIIKWNLQVNQIGTVTESIRAALDSKAAGWGVM
   Os_LOC_Os09g20820.1 (380)  AIGKKACNALLLK-----------VNQIGTVTESIQAALDSKAAGWGVM
         Zm_enolase_2  (457)  AIDRKACNALLLK-----------VNQIGTVTESIQAALDSKAAGWGVM
         AT2G29560     (374)  AIQESSCNALLLK-----------VNQIGTVTEAIEVVKMARDAQWGVV
    Pt_scaff_IX.1243   (431)  AIHESSCTALLLK-----------VNQIGTVTEALEVVKLAKDAHWGVV
   Os_LOC_Os03g15950.1 (374)  AVNEYTCNALVLK-----------ANQVGTVTEAIEVVRQAKDAHWGVM
            Ot_enolase (375)  AIDGKWCNALLLK-----------VNQIGTISESIEAVGMSKRAGWGVM
         AT2G36530.1   (340)  AIAEKSCNALLLK-----------VNQIGTVTESIEAVKMSKKAGWGVM
     Gm_enolase_Hyseq_2(340)  AIDTKACNALLLK-----------VNQIGSVTESIEAVRMSKKAGWGVM
        Pt_scaff_28.296(368)  AIKEKACNALLLK-----------VNQIGSVTESIEAVKMSKQAGWGVM
       Gm_enolase_Hyseq(341)  AIKEKACNALLLK-----------VNQIGSVTESIEAVRMSKQAGWGVM
       Pt_scaff_XV.1093(341)  AIKEKSCNALLLK-----------VNQIGSVTESIEAVKMSKHAGWGVM
            enolase_TM (342)  AIQEKSCNALLLK-----------VNQIGSVTESIEAVKMSKRAGWGVM
       Os_LOC_Os10g08550(376) AIQEKSCNALLLK-----------VNQIGSVTESIEAVKMSKRAGWGVM
            Hv_enolase (342)  AIQEKSCNALLLK-----------VNQIGSVTESIEAVKMSKHAGWGVM
         Zm_enolase_1  (342)  AIKEKSCNALLLK-----------VNQIGSVTESIEAVKMSKRAGWGVM
   Os_LOC_Os03g14450.1 (341)  AIKDKACNALLLK-----------VNQIGSVTESIEAVKMSKRAGWGVM
   Os_LOC_Os03g14450.2 (289)  AIKDKACNALLLK-----------VNQIGSVTESIEAVKMSKRAGWGVM
   Os_LOC_Os06g04510.1 (342)  AISEKTCNALLLK-----------VNQIGSVTESIEAVRMSKRAGWGVM
         Zm_enolase_3  (342)  AINEKTCNALLLK-----------VNQIGSVTESIEAVRMSKRAGWGVM
             Consensus (551)  AI EKSCNALLLK           VNQIGSVTESIEAVKMSK AGWGVM
```

FIGURE 3 (continued)

```
                              601                                              650
           AT1G74030    (416) VSHRSGETEDNFIADLSVGLASGQIKTGAPCRSERLSKYNQLLRIEEELG
       Pt scaff_XII.488 (433) VSHRSGETEDNFIADLSVGLASGQIKTGAPCRSERLAKYNQLLRIEEELG
     Os LOC_Os09g20820.1 (418) VSHRSGETEDNFIADLAVGLASGQIKTGAPCRSERLAKYNQLLRIEMELG
            Zm_enolase_2 (495) VSHRSGETEDNFIADLAVGLASGQIKTGAPCRSERLAKYNQLLRIEEGLG
              AT2G29560 (412) TSHRCGETEDSFISDLSVGLATGVIKAGAPCRGERTMKYNQLLRIEEELG
        Pt scaff_IX.1243 (469) VSHRSGETEDSFIADLSVGLAMGQIKTGAPCRGERLAKYNQLLRIEEELG
     Os LOC_Os03g15950.1 (412) VSHRSGDTDDSFIADLAVGAAAGQIKAGAPCRGECLSKYNQLLRIEEELG
              Ot enolase (413) ASHRSGETEDCFIADLAVGLSTGQIKTGAPCRSERLAKYNQLLRIEEELG
            AT2G36530.1 (378) TSHRSGETEDTFIADLAVGLSTGQIKTGAPCRSERLAKYNQLLRIEEELG
      Gm enolase Hyseq_2 (378) ASHRSGETEDTFIADLSVGLATGQIKTGAPCRSERLAKYNQLLRIEEELG
         Pt scaff_28.296 (406) ASHRSGETEDTFIADLSVGLATGQIKTGAPCRSERLAKYNQILRIEEELG
        Gm enolase Hyseq (379) ASHRSGETEDTFIADLSVGLATGQIKTGAPCRSERLAKYNQLLRIEEELG
         Pt scaff_XV.1093 (379) ASHRSGETEDTFIADLSVGLSTGQIKTGAPCRSERLAKYNQLLRIEEELG
              enolase TM (380) TSHRSGETEDTFIADLAVGLATGQIKTGAPCRSERLAKYNQLLRIEEELG
       Os LOC_Os10g08550 (414) TSHRSGETEDTFIADLAVGLATGQIKTGAPCRSERLAKYNQLLRIEEELG
              Hv enolase (380) TSHRSGETEDTFIADLAVGLSTGQIKTGAPCRSERLAKYNQLLRIEEELG
            Zm enolase_1 (380) TSHRSGETEDTFIADLAVGLSTGQIKTGAPCRSERLAKYNQLLRIEEELG
     Os LOC_Os03g14450.1 (379) TSHRSGETEDTFIADLAVGLSTGQIKTGAPCRSERLAKYNQLLRIEEELG
     Os LOC_Os03g14450.2 (327) TSHRSGETEDTFIADLAVGLSTGQIKTGAPCRSERLAKYNQLLRIEEELG
     Os LOC_Os06g04510.1 (380) ASHRSGETEDTFIADLSVGLSTGQIKTGAPCRSERLAKYNQLLRIEEELG
            Zm enolase_3 (380) ASHRSGETEDTFIADLSVGLSTGQIKTGAPCRSERLAKYNQLLRIEEELG
               Consensus (601)    SHRSGETEDTFIADLAVGLATGQIKTGAPCRSERLAKYNQLLRIEEELG 651              676
           AT1G74030    (466) -NVRYAGEAFRSP-------------
       Pt scaff_XII.488 (483) -NVRYAGEAFRSL-------------
     Os LOC_Os09g20820.1 (468) -NVRYAGEAFRSP-------------
            Zm_enolase_2 (545) -NVRYAGEAFRSP-------------
              AT2G29560 (462) DQAVYAGEDWKLSL------------
        Pt scaff_IX.1243 (519) DQAVYAGEDWRAT-------------
     Os LOC_Os03g15950.1 (462) SDGVYAGENWRTTASTS---------
              Ot enolase (463) DAAVYAGENYKHIAW-SASRFRRSP-
            AT2G36530.1 (428) SEAIYAGVNFRKPVEPY---------
      Gm enolase Hyseq_2 (428) AEAVYAGANFRTPVEPY---------
         Pt scaff_28.296 (456) AEAVYAGANFRRPVEPY---------
        Gm enolase Hyseq (429) SAAVYAGAKFRAPVEPY---------
         Pt scaff_XV.1093 (429) SAAVYAGAKFRAPVEPY---------
              enolase TM (430) AAAVYAGAKFRAPVEPY---------
       Os LOC_Os10g08550 (464) AAAVYAGAKFRAPVEPY---------
              Hv enolase (430) AAAVYAGLKFRAPVEPY---------
            Zm enolase_1 (430) AIAVYAGAKFRAPVEPY---------
     Os LOC_Os03g14450.1 (429) AAAVYAGAKFRAPVEPY---------
     Os LOC_Os03g14450.2 (377) AAAVYAGAKFRAPVEPY---------
     Os LOC_Os06g04510.1 (430) DAAVYAGEKFRAPVEPY---------
            Zm enolase_3 (430) DAAVYAGAKFRAPVEPY---------
               Consensus (651) A AVYAG   FRAPVEPY
```

FIGURE 3 (continued)

MUSCLE (3.7) multiple sequence alignment

```
A.thaliana_AT2G04620              ------------------------------------------------------------M
P.tricornutum_23557               ------------------------------------------------------------M
A.thaliana_AT2G29410              ---------------------------------------------LNCLCSCLHISNHK
V.vinifera_GSVIVT24226001         ------------------------------------------------------------M
P.patens_119800                   ------------------------------------------------------------
P.patens_58387                    ------------------------------------------------------------
C.tinctorius_TA2425               ------------------------------------------------------------M
O.sativa_Os05g03780               ------------------------------------------------------------M
Z.mays_TA176521                   ------------------------------------------------------------M
E.grandis_AF197329                ------------------------------------------------------------M
I.nil_TA6615                      ------------------------------------------------------------M
N.benthamiana_TA8245              ------------------------------------------------------------M
N.tabacum_TA14631                 ------------------------------------------------------------M
P.trichocarpa_II672               MIGYTIAFNNRKEHLPIYITDNMVSHKLGEFAPTLNFRGHATEHPPYQIHPHGRVNWKTM
P.trichocarpa_XIV.515             ------------------------------------------------------------M
A.thaliana_AT3G61940              ------------------------------------------------------------M
A.thaliana_AT2G46800              ------------------------------------------------------------M
T.caerulescens_TA62               ------------------------------------------------------------M
A.thaliana_AT3G58810              ---------------------------------------------MVTPKLHLDLSLTK
P.trichocarpa_I910                ------------------------------------------------------------M
P.trichocarpa_XI272               ------------------------------------------------------------M A.thaliana_AT2G04620              VDHHHHHHHQHRPNRLSVPQPTIGRTYPSFPYTPTPTPSKTRLSSSSSYRSIHG-SKSSL
P.tricornutum_23557               HDHD--HEHNC-------------------------SSHHEKGLPTPSPTL--------
A.thaliana_AT2G29410              IKLKISEEDSS--------------------------GIHIRFASPSDSQLMEL-EQ---
V.vinifera_GSVIVT24226001         EDNEVSIRTEH--------------------------QQEIEMSKASKENVLTMPSQ---
P.patens_119800                   --------------------------------------------------MK---
P.patens_58387                    ---------------------------------------------------M---
C.tinctorius_TA2425               DAEN--RGHGH--------------------------AVDISADAPAEENRLTG-SK---
O.sativa_Os05g03780               DSHN--SAPPQ--------------------------IAEVRMDISSSTSVAAG-NK---
Z.mays_TA176521                   ENHN--PLHSQ--------------------------IAEVKMDISASASVASG-NK---
E.grandis_AF197329                STHD--SEHGH--------------------------IIEVCQDVPAMETGQVG-SK---
I.nil_TA6615                      DVRI--SEHDQ--------------------------VIQVSGDVPAQERGAVG-SK---
N.benthamiana_TA8245              ETQN--LERGH--------------------------VIEVRCDMAAQEK---G-TK---
N.tabacum_TA14631                 ETQN--LERGH--------------------------VIEVRCDMAAQEK---G-TK---
P.trichocarpa_II672               EEQN--TQHAP--------------------------PVETSVDI--LDGGDSGASN---
P.trichocarpa_XIV.515             EAQN--PQHGH--------------------------PVEISVDILDGEMSG-G-SK---
A.thaliana_AT3G61940              DSRR---------------------------------------------SK---
A.thaliana_AT2G46800              ESSS--PHHSH--------------------------IVEVNGKSDEERIIVA-SK---
T.caerulescens_TA62               ESSS------H--------------------------IIEVNGGRSDEERRAVA-SK---
A.thaliana_AT3G58810              KMKDHIHEHDH--------------------------MVQICGEVSSGETSLVGIKK---
P.trichocarpa_I910                DVRN--SEHGR--------------------------VIEVHVDVPAAENSLGG-SR---
P.trichocarpa_XI272               EVRN--SEHGR--------------------------IIDIHVDVPAVKTSLGG-SR---
```

FIGURE 6

```
A.thaliana_AT2G04620         SFLFLILFSLRSLYSLLPFLRSSPSFSLFPFSFLVSLLSFLFSLSFTIISSFSPSKKDPF
P.tricornutum_23557          ------------------------------------------------------------
A.thaliana_AT2G29410         ------------------------------------------------------------
V.vinifera_GSVIVT24226001    ------------------------------------------------------------
P.patens_119800              ------------------------------------------------------------
P.patens_58387               ------------------------------------------------------------
C.tinctorius_TA2425          ------------------------------------------------------------
O.sativa_Os05g03780          ------------------------------------------------------------
Z.mays_TA176521              ------------------------------------------------------------
E.grandis_AF197329           ------------------------------------------------------------
I.nil_TA6615                 ------------------------------------------------------------
N.benthamiana_TA8245         ------------------------------------------------------------
N.tabacum_TA14631            ------------------------------------------------------------
P.trichocarpa_II672          ------------------------------------------------------------
P.trichocarpa_XIV.515        ------------------------------------------------------------
A.thaliana_AT3G61940         ------------------------------------------------------------
A.thaliana_AT2G46800         ------------------------------------------------------------
T.caerulescens_TA62          ------------------------------------------------------------
A.thaliana_AT3G58810         ------------------------------------------------------------
P.trichocarpa_I910           ------------------------------------------------------------
P.trichocarpa_XI272          ------------------------------------------------------------

A.thaliana_AT2G04620         LLRLQNRSFSSISSLSSSQIKLLLAKSFLLAFVFLLRFQALRYCGAAAMILAELSGTVSA
P.tricornutum_23557          ------------------------------------------------------------
A.thaliana_AT2G29410         ---------------------------------------ICILKPDDEEEMESPSPS
V.vinifera_GSVIVT24226001    ---------------------------------------LSCCHI------------
P.patens_119800              ---------------------------------------CANNHT------------
P.patens_58387               ---------------------------------------KCAATR------------
C.tinctorius_TA2425          ---------------------------------------VCGGAP------------
O.sativa_Os05g03780          ---------------------------------------VCRGAA------------
Z.mays_TA176521              ---------------------------------------FCKGGA------------
E.grandis_AF197329           ---------------------------------------VCAEAP------------
I.nil_TA6615                 ---------------------------------------LCGEAP------------
N.benthamiana_TA8245         ---------------------------------------ICGSAP------------
N.tabacum_TA14631            ---------------------------------------ICGSAP------------
P.trichocarpa_II672          ---------------------------------------VCGEAP------------
P.trichocarpa_XIV.515        ---------------------------------------GCGEAP------------
A.thaliana_AT3G61940         ---------------------------------------VCGETA------------
A.thaliana_AT2G46800         ---------------------------------------VCGEAP------------
T.caerulescens_TA62          ---------------------------------------VCGEAP------------
A.thaliana_AT3G58810         ---------------------------------------TCGEAP------------
P.trichocarpa_I910           ---------------------------------------ICGGVS------------
P.trichocarpa_XI272          ---------------------------------------ICAGAT------------
```

FIGURE 6 (continued)

```
A.thaliana_AT2G04620         R-----------VLFSDTGGIGVRSSKVRGFCVLFAGLLLLSISWDRVDCFPFSSSVESW
P.tricornutum_23557          ------------DGVSDSG-----------------------------------------
A.thaliana_AT2G29410         KTEENLGVVPLSCAFTRQE-----------------------------------------
V.vinifera_GSVIVT24226001    ------------CAFSQHE-----------------------------------------
P.patens_119800              ------------CSLESNN-----------------------------------------
P.patens_58387               ------------CGLESVG-----------------------------------------
C.tinctorius_TA2425          ------------CGFSDAK-----------------------------------------
O.sativa_Os05g03780          ------------CDFSDSS-----------------------------------------
Z.mays_TA176521              ------------CDFSDSS-----------------------------------------
E.grandis_AF197329           ------------CGFSDVR-----------------------------------------
I.nil_TA6615                 ------------CGFADAK-----------------------------------------
N.benthamiana_TA8245         ------------CGFSDVN-----------------------------------------
N.tabacum_TA14631            ------------CGFSDVN-----------------------------------------
P.trichocarpa_II672          ------------CVFSDTG-----------------------------------------
P.trichocarpa_XIV.515        ------------CGFSDTG-----------------------------------------
A.thaliana_AT3G61940         ------------CGFS--------------------------------------------
A.thaliana_AT2G46800         ------------CGFSDSK-----------------------------------------
T.caerulescens_TA62          ------------CGFSDAK-----------------------------------------
A.thaliana_AT3G58810         ------------CGFSDAK-----------------------------------------
P.trichocarpa_I910           ------------CGFSDAQ-----------------------------------------
P.trichocarpa_XI272          ------------CGFSDAK-----------------------------------------

A.thaliana_AT2G04620         BGFWIYPKENCLRIWPLLLPFLSGFLGCYEKVSVNWNEIKQLDQKRVRLLSLFLTTVLLFP
P.tricornutum_23557          ------------------------------------------------------------
A.thaliana_AT2G29410         ------------------------------------------------------------
V.vinifera_GSVIVT24226001    ------------------------------------------------------------
P.patens_119800              ------------------------------------------------------------
P.patens_58387               ------------------------------------------------------------
C.tinctorius_TA2425          ------------------------------------------------------------
O.sativa_Os05g03780          ------------------------------------------------------------
Z.mays_TA176521              ------------------------------------------------------------
E.grandis_AF197329           ------------------------------------------------------------
I.nil_TA6615                 ------------------------------------------------------------
N.benthamiana_TA8245         ------------------------------------------------------------
N.tabacum_TA14631            ------------------------------------------------------------
P.trichocarpa_II672          ------------------------------------------------------------
P.trichocarpa_XIV.515        ------------------------------------------------------------
A.thaliana_AT3G61940         ------------------------------------------------------------
A.thaliana_AT2G46800         ------------------------------------------------------------
T.caerulescens_TA62          ------------------------------------------------------------
A.thaliana_AT3G58810         ------------------------------------------------------------
P.trichocarpa_I910           ------------------------------------------------------------
P.trichocarpa_XI272          ------------------------------------------------------------
```

FIGURE 6 (continued)

```
A.thaliana_AT2G04620          LAIWSFFFSGSGDDSVSFGNLGWPLANTVVFGVLLSENYNDDKFSSSKKKDSEREFLVTF
P.tricornutum_23557           ------------------------------------------------SHNAAQQQRLQVLRR
A.thaliana_AT2G29410          ------------------------------------------------HCVSETKEREESTRR
V.vinifera_GSVIVT24226001     ------------------------------------------------ISRSESEQRSKSSRK
P.patens_119800               ------------------------------------------------TIEQDKIERENASKK
P.patens_58387                ------------------------------------------------GMEQDEVERRASSKK
C.tinctorius_TA2425           ------------------------------------------------ASSKEARERSASMWK
O.sativa_Os05g03780           ------------------------------------------------NSSKDARERMASMRK
Z.mays_TA176521               ------------------------------------------------NSSKDAKERSTSMRK
E.grandis_AF197329            ------------------------------------------------NSLKDARERSTSTKK
I.nil_TA6615                  ------------------------------------------------TSLKDTQERSAAMKK
N.benthamiana_TA8245          ------------------------------------------------TMSKDAQERSASMRK
N.tabacum_TA14631             ------------------------------------------------TMSKDAQERSASMRK
P.trichocarpa_II672           ------------------------------------------------NNLKNAKERSTSMRK
P.trichocarpa_XIV.515         ------------------------------------------------NNSKNAKERSASMRK
A.thaliana_AT3G61940          ------------------------------------------------TSSSDAKRAASMRK
A.thaliana_AT2G46800          ------------------------------------------------NASGDAHERSASMRK
T.caerulescens_TA62           ------------------------------------------------NVSGDTKERNASMRK
A.thaliana_AT3G58810          ------------------------------------------------TSSIEAQERAASMRK
P.trichocarpa_I910            ------------------------------------------------TSSKDAKERGASMKK
P.trichocarpa_XI272           ------------------------------------------------TSSKDAKERGASMKK A.thaliana_AT2G04620          LCTIVLELFYFPELSLWGLLLCGLLLYIAVRELESVYSDYQEIGMESPESFSTMFMKPIR
P.tricornutum_23557           LQ-------------TATVLCLC------------------------------------
A.thaliana_AT2G29410          LS-------------SLIFLYLI------------------------------------
V.vinifera_GSVIVT24226001     LC-------------GLIIFYLI------------------------------------
P.patens_119800               LK-------------KAMIFCIF------------------------------------
P.patens_58387                LS-------------RAVMICLF------------------------------------
C.tinctorius_TA2425           LW-------------GGVILCFI------------------------------------
O.sativa_Os05g03780           LI-------------IAVILCII------------------------------------
Z.mays_TA176521               LI-------------IAVILCII------------------------------------
E.grandis_AF197329            LL-------------IAVVLCII------------------------------------
I.nil_TA6615                  LC-------------IAVVLCVV------------------------------------
N.benthamiana_TA8245          LC-------------IAVVLCII------------------------------------
N.tabacum_TA14631             LC-------------IAVVLCII------------------------------------
P.trichocarpa_II672           LW-------------IAVALCVV------------------------------------
P.trichocarpa_XIV.515         LW-------------ISVALCIV------------------------------------
A.thaliana_AT3G61940          LC-------------FVVVLCLL------------------------------------
A.thaliana_AT2G46800          LC-------------IAVVLCLV------------------------------------
T.caerulescens_TA62           LC-------------IAVVLCLV------------------------------------
A.thaliana_AT3G58810          LL-------------IAVLLCAI------------------------------------
P.trichocarpa_I910            LG-------------WAVGLCLV------------------------------------
P.trichocarpa_XI272           LG-------------WAVVLCLI------------------------------------
```

FIGURE 6 (continued)

```
A.thaliana_AT2G04620          HILSEKKSRKIALFLLINTAYMVVEFVAGFMSNSLGLISDACHMLFDCAALAIGLYASYI
P.tricornutum_23557           ------------------FMTIEVIGGFWAGSLAVLSDAAHLLADTASFAIAIVANYL
A.thaliana_AT2G29410          ------------------VMSVQIVGGFKANSLAVMTDAAHLLSDVAGLCVSLLAIKV
V.vinifera_GSVIVT24226001     ------------------FMAVEIVGGIKSNSLAVLTDAAHLLSDVFGFSISLFAVWA
P.patens_119800               ------------------FMCVEVVGGMYANSLAILTDAAHLLSDIAGFAISLFAIWA
P.patens_58387                ------------------FMVVEIVGGLYANSLAILTDAAHLLTDVAGFALSLFAIWA
C.tinctorius_TA2425           ------------------FMGVEVFGGIKANSLAILTDAAHLLSDVAAFAISLFSVWA
O.sativa_Os05g03780           ------------------FMAVEVVGGIKANSLAILTDAAHLLSDVAAFAISLFSLWA
Z.mays_TA176521               ------------------FMTVEVVGGIKANSLAILTDAAHLLSDVAAFAISLFSLWA
E.grandis_AF197329            ------------------FMSIEVFGGIEANSLAILTDAAHLLSDVAAYAISLFSLWA
I.nil_TA6615                  ------------------FMTVEVIGGIKANSLAILTDAAHLLSDVAAFAISLFSLWA
N.benthamiana_TA8245          ------------------FMAVEFVGGIKANSLAILTDAAHLLSDVAAFAISLFSLWA
N.tabacum_TA14631             ------------------FMAVEVVGGIKANSLAILTDAAHLLSDVAAFAISLFSLWA
P.trichocarpa_II672           ------------------FMSAEVAGGIKANSLAILTDAAHLLSDVAAFAISLFSFWA
P.trichocarpa_XIV.515         ------------------FMSAEVAGGIEANSLAILTDAAHLLSDVAGFAISLFSLWA
A.thaliana_AT3G61940          ------------------FMSIEVVCGIKANSLAILADAAHLLTDVGAFAISMLSLWA
A.thaliana_AT2G46800          ------------------FMSVEVVGGIKANSLAILTDAAHLLSDVAAFAISLFSLWA
T.caerulescens_TA62           ------------------FMSVEIVGGIKANSLAIMTDAAHLLSDVAAFAISLFALWA
A.thaliana_AT3G58810          ------------------FIVVEVVGGIKANSLAILTDAAHLLSDVAAFAISLFSLWA
P.trichocarpa_I910            ------------------FMAVEIAGGIKANSLAILTDAAHLLSDVAAFAISLFSIWA
P.trichocarpa_XI272           ------------------FMAVEIVGGIKANSLAILTDAAHLLSDVAAFAISLFSIWA A.thaliana_AT2G04620          SRLPANHQYNYGRGRFEVLSGYVNAVFLVLVGALIVLESIERIL---------DPQ-EIS
P.tricornutum_23557           ARMPSTVTHTYGLQRTESLAALFSMVSLAIVCVGLASEASRRLYHIVMQDDAAEELLNVD
A.thaliana_AT2G29410          SSWEANPRNSFGFKRLEVLAAFLSVQLIWLVSGVIIHEAIQRLLS--------RSR-EVN
V.vinifera_GSVIVT24226001     SGWRATSQQSFGFNRVEVLGALFSVQLIWLIAGILIYEAVNRILH--------QHA-KVN
P.patens_119800               SSWESTAIQSYGFFRLEILGALVSIQFIWLVTGMLLVYEAFERLYD--------SNKDIVN
P.patens_58387                SGWEATPLQTFGFSRLEILGALGSILFIWLLTGILVFEAIKRLLT--------EVA-PID
C.tinctorius_TA2425           SGWEATPRQSYGFFRIEILGTLVSIQIIWLLTGILVYEAIVRLIH--------GTI-EVE
O.sativa_Os05g03780           AGWEATPQQSYGFFRIEILGALVSIQLIWLLAGILVYEAIVRLIN--------ESG-EVQ
Z.mays_TA176521               AGWEATPQQSYGFFRIEILGALVSIQLIWLLAGILVYEAIVRLIN--------ESG-DVQ
E.grandis_AF197329            SGWEATPRQSYGFFRIEILGALVSIQIIWLLAGILVYEAIERLIN--------GTT-EVH
I.nil_TA6615                  AGWEATPRQSYGFFRIEILGALVSIQMIWLLAGILVYEAIDRLIN--------DTG-EVQ
N.benthamiana_TA8245          AGWEANPRQSYGFFRIEILGALVSIQMIWLLAGILVYEAIARLIH--------DTG-EVQ
N.tabacum_TA14631             AGWEANPRQSYGFFRIEILGALVSIQMIWLLAGILVYEAIARLIH--------DTG-EVQ
P.trichocarpa_II672           AGWEATPRQSYGFVRIEVLGALVSIQLIWLLAGILVYEAIVRLIH--------DTG-EVD
P.trichocarpa_XIV.515         AGWEATPRQSYGFFRIEILGALVSMQLIWLLAGILVYETIIRLIH--------GTS-EVN
A.thaliana_AT3G61940          SSWEANPRQSYGFFRIEILGTLVSIQLIWLLGILVYEAVTRLVQ--------ETNDDVD
A.thaliana_AT2G46800          AGWEATPRQTYGFFRIEILGALVSIQLIWLLTGILVYEAIIRIVT--------ETS-EVN
T.caerulescens_TA62           AGWEATPRQTYGFFRIEILGALVSIQLIWLLTGILVYEAISRLLT--------ETS-EVN
A.thaliana_AT3G58810          SGWKANPQQSYGFFRIEILGALVSIQMIWLLAGILVYEAIVRLNN--------GSG-EVE
P.trichocarpa_I910            SGWEATPRRTYGYFRIEILGALISIQMIWLLAGILVYEAIVRIIH--------DTG-EVK
P.trichocarpa_XI272           SGWEATPRRTYGYFRIEILGALISIQMIWLLAGILVYEAIARLIY--------DTG-EVQ
```

FIGURE 6 (continued)

```
A.thaliana_AT2G04620            TNSLLVVSVGGLLVNIVGLIFFHEE-HHHAHGGSGCTHSHSHQ-SHSHK----------
P.tricornutum_23557             GRLMSGIATIGVCVNIVLALVLGEH-HVHLPS-YGDSHGHDHH---------------
A.thaliana_AT2G29410            GEIMFGISAFGFFMNLVMVLWLGHN-HSHHH---------------------------
V.vinifera_GSVIVT24226001       GKLMFAIAAFGFISNLIMVTWLGHD-HTH----HDCGH--------------------
P.patens_119800                 GTVMFGIAILGLFVNIAMIVLLGHENYSFNIGNHEHHHNHGHD-SHENG----------
P.patens_58387                  GRLMFCIASVGLLVNLCMMVLLGHE-HGHAHG-HGHSHGHGHGHGHEHS----------
C.tinctorius_TA2425             GRLMFIIAAFGLIVNIVMIFILGHD-HGHGH-HSHGHGHGHG--H-------------
O.sativa_Os05g03780             GSLMFAVSAFGLFVNIIMAVLLGHD-HGHGHG-HGHGHGHSHD--HDHG----------
Z.mays_TA176521                 GSLMFAVSAFGLFVNIIMAVLLGHD-HGHGHG-HSHGHPHDHG--HGDS----------
E.grandis_AF197329              GFLMFIIAAFGLLVNIAMALLLGHD-HSHGHG-HDHGHGHSHG--HDDA----------
I.nil_TA6615                    GSLMFAVSAFGLVVNIIMAVLLGHD-HGHGHG-HGHGHDHGHG-GHDHG----------
N.benthamiana_TA8245            GFLMFVVSAFGLAVNLIMALLLGHD-HGHGHG-HGHGHSHGHEHGHEHG----------
N.tabacum_TA14631               GFLMFVVSAFGLVVNLIMALLLGHD-HGHGHG-HGHSHGHDHEHGHNHG----------
P.trichocarpa_II672             GFLMFLVAAFGLLVNIVMALVLGHD-HGHDHD-HNHGTGHSHG---------------
P.trichocarpa_XIV.515           GFLMFLVAAFGLLVNIIMALVLGHD-HGPDHD-HKHGTGHSHG---------------
A.thaliana_AT3G61940            GFFMVLVAAFGLVNIVVLGHD-HGHGHD-HGHSHDHGHS--------------------
A.thaliana_AT2G46800            GFLMFLVAAFGLVVNIIMAVLLGHD-HGHSHG-HGHGHGHDH----------------
T.caerulescens_TA62             GFLMFAVATFGLLVNIIMAVMLGHD-HGHSHG-HGHDHEN-----HSHG----------
A.thaliana_AT3G58810            GSLMFAVSAVGLLVNIAMAILLGHD-HGHGHG-HSHDNGHGHS--------------
P.trichocarpa_I910              GALMFAVAAVGLLVNIGMAFLLGHD-HGHGHG-HGHGHGHGHG--HEHGEHNHDHSDDGH
P.trichocarpa_XI272             GALMFAVSAVGLLVNIVMALLLGHD-HGHAHG-HG-GHDHGHS---------------

A.thaliana_AT2G04620            --------------NEEHHQHSDSHKHEEHHQHSDSHKHEEHHEHDHHHHSHSHKHEECN
P.tricornutum_23557             -------------------------------------------------HDHVHPATESS
A.thaliana_AT2G29410            ----------------------------------------------HDHHHHHHNHKHQ
V.vinifera_GSVIVT24226001       --------------------------KDHDHDHHD-----------YHDHHHHHHHE
P.patens_119800                 ----------------------SSNSYKNHKHDNFDESFDLHGDKDHEHDTSHKNVNPN
P.patens_58387                  -----------------HEDDHGNGHSHDHGHGHSHDDEHV--------HSHGSESQGT
C.tinctorius_TA2425             -----------------------------QEHDHGDSQEDVIHGVSVTTHHHHHGPGHD
O.sativa_Os05g03780             ----------------GSDHDHHHHEDQEHGHVHHHEDGHGNSITVNLHHHPGTGH---
Z.mays_TA176521                 -------------------DDGHSHHEEPEQGHVHHEHSHGSSITVTTHHHHHSGTGQH
E.grandis_AF197329              ---------------HEHSDHAHSH---EDHGDLHTH---GLT-IKKHDHHHHGEDSKGH
I.nil_TA6615                    ------------------------HGG-HDHGHSH-------DGVTIVQHHDHHEGHSGH
N.benthamiana_TA8245            --------------HNHEEHAHSHSD-HEHGHGEHT---HIHGISVSRHHHHNEGPSSR
N.tabacum_TA14631               ----------------EHAHSNTD-HEHGHGEHT---HIHGISVSRHHHHNEGPSSR
P.trichocarpa_II672             --------------------------------------MTVTTHHRHHDEHPKD
P.trichocarpa_XIV.515           ----------------------TTVSTHNHHHVEHP----------KHDDNHHDHSN
A.thaliana_AT3G61940            ----------------------------YGERA-----------------------
A.thaliana_AT2G46800            ---------------------------HNHSHGVTV-------TTHHHHHDHEHGHSHG
T.caerulescens_TA62             ----------------VTVTTHDHDPTHDHDHDH-------------DHDDGHGHSHG
A.thaliana_AT3G58810            ---------------------------HDHGHGIAA----------TEHHHDSGHDES
P.trichocarpa_I910              SHEGDDGHSHEGDDGHSHEDHDHSH---EDHDHAHNH---MLSGATHHNHHHHEGSSENN
P.trichocarpa_XI272             -------------------DHDHSH---EDHDHTHTN---SLSGATHHNHHHHEGNSEDN
```

FIGURE 6 (continued)

```
A.thaliana_AT2G04620         HNHDHEHQSHSHNHE-----ECNHNHDHHSDHQPEKSEKKEHRHIDHNMEGIFLHVLADT
P.tricornutum_23557          ALLPKSTNGD---VE-----HCVIHNDEA---------VPDKARNVNLHAAYLHVLGDL
A.thaliana_AT2G29410         HQHHH-------------KEVVAEEEEEEMNPLKGEKSSSKEMNINIQGAYLHAMADM
V.vinifera_GSVIVT24226001    SDKPCSMDEE----ES-----TKLVSSSP----------EKTKILNINLQGAYLHVMADL
P.patens_119800              STSSKTHEE----------NNFNDEKHDVSMLSKTTATVQHGHNNLNLQGAYLHVLGDA
P.patens_58387               HDGQHGHSSHKHNTS-----QPLLKKSHSVSLCRDLS--KKKPERNINVQGAYLHVLGDL
C.tinctorius_TA2425          HGHDHGHGHDEQQLQ-----QPLLKTYSGGE--------VKEKKRNINVQSAYLHVLGDS
O.sativa_Os05g03780          ------HHHD---AE-----EPLLKSDAGCDSTQSGAKDAKKARRNINVHSAYLHVLGDS
Z.mays_TA176521              HD---------AE-----EPLIKHEADCEGTQSAA---KKPRRNINVHSAYLHVLGDS
E.grandis_AF197329           ADQLHGHETD---QT-----EPLLQTCSEAEGDSKLGA-KQKQQRNINMQGAYLHVLGDS
I.nil_TA6615                 NE----HESD---HT-----HPLLKACSEGENGSKGG---KKKERNINVQGAYLHVLGDS
N.benthamiana_TA8245         DQHSHAHDAD---HT-----EPLLKDSCEGEGVPEGE--KKKKQRNINVQGAYLHVLGDS
N.tabacum_TA14631            DQHPHAHDGD---HT-----VPLLKNSCEGESVSEGE--KKKKQQNINVQGAYLHVIGDS
P.trichocarpa_II672          AGNHHKHSKDEHRHAHEEHVEPLLDKKEAR--------HEKKQRNINVQGAYIHVLGDS
P.trichocarpa_XIV.515        NEHHHAHED----HV-----EPLLDKGEAM---------HEKKQRNINVQGAYLHVLGDS
A.thaliana_AT3G61940         -------------------EQLLE-------------KSKEIRNINVQGAYLHVLGDL
A.thaliana_AT2G46800         HGEDKHHAHGD--VT-----EQLLDKSKTQVAA------KEKRKRNINLQGAYLHVLGDS
T.caerulescens_TA62          EDNQDEAHGD---VT-----EQLLEKPKQE---------KEKKKRNINLQGAYLHVLGDS
A.thaliana_AT3G58810         Q-----------LS-----DVLI-------------EQKKQRNVNIQGAYLHVLGDS
P.trichocarpa_I910           DEHHHTHGAD---LA-----EPLLSTHTEVDNKTKGGS-KQKQQRNINVQGAYLHVLGDS
P.trichocarpa_XI272          GEHHDTHGAD---LA-----EPLLSSHTEVENKTNGGH-KQKKQRNINIQGAYLHVLGDS A.thaliana_AT2G04620         MGSVGVVISTLLIKYK-GWLVADPASSIFISILIIASVIPLLRNSAEILLQRVPRAHRQD
P.tricornutum_23557          AQSVAVLIAGIVIWLKPSWAIVDPICTLGFCGLVFYSTLGVLRSSIAVLLEEVPPH--VS
A.thaliana_AT2G29410         IQSLGVMIGGGIIWVKPKWVLVDLICTLVFSAFALAATLPILKNIFGILMERVPRD--MD
V.vinifera_GSVIVT24226001    IQSVGVMVAGGIIWAKPEWLMVDLVCTLCFSVLVLTTTLMRNIFSILMERAPIE--ID
P.patens_119800              IQSIGVIIGAAAIWYNPKWKIIDVICTILFSVLVLGTTIQMLKDVLHILMESTPHE--IN
P.patens_58387               LQSVGVMIGGAVIWYQPRWKVIDPVCTLIFSVLVLCTTLSMIRSIVEVLMESTPRE--ID
C.tinctorius_TA2425          IQSIGVMIGAGVIWYKPELKIIDPICALLFSIIVLYTTINMLRDILEVLMESTPRE--ID
O.sativa_Os05g03780          IQSIGVMIGGAIIWYKPEWKIIDLICTLIFSVIVLFTTIKMLRNILEVLMESTPRE--ID
Z.mays_TA176521              IQSIGVMIGGAIIWYKPEWKIIDLICTLIFSVVVLFTTIRMLRNILEVLMESTPRE--ID
E.grandis_AF197329           IQSVGVMIGGAIIWIKPEWTIVDLICTLIFSVIVLGTTIRMLRNILEVLMESTPRE--ID
I.nil_TA6615                 IQSVGVMIGGAIIWYKPEWKIIDLFCTLIFSVLVLVGTTIKMLRNILEVLMESTPRE--ID
N.benthamiana_TA8245         IQSIGVMIGGAIIWYKPEWKIIDLICTLIFSVIVLGATIKMLRSILEVLMESTPRE--ID
N.tabacum_TA14631            IQSIGVMIGGAIIWYKPEWKIIDLICTLIFSVIVLRTTIRMLRSILEVLMESTPRE--ID
P.trichocarpa_II672          IQSIGVMIGGAIWYKPEWKIVDVICTLFFSVIVLGTTIKMLRNILDVLMESTPRE--ID
P.trichocarpa_XIV.515        IQSIGVMIGGAIIWYKPEWKIIDLICTLIFSVIVLGTTIKMLRNILEVLMESTPRE--ID
A.thaliana_AT3G61940         IQSIGVMIGGGMIWYNPKWKVIDLICTLFFSVIVLGTTIKMLRSILEVLMESTPRE--ID
A.thaliana_AT2G46800         IQSVGVMIGGAIWYNPEWKVIDLCTLAFSVIVLGTTINMIRNILEVLMESTPRE--ID
T.caerulescens_TA62          IQSVGVMIGGAAIWYNPKWKIIDLCTLAFSVIVLGTTINMIRNILEVLMESTPRE--ID
A.thaliana_AT3G58810         IQSVGVMIGGAIIWYKPEWKILDLICTLVFSVIVLGTTIGMLRNILEVLMESTPRE--ID
P.trichocarpa_I910           IQSVGVMIGGAIIWYKPEWKIIDLICTLAFSIIVLGTTIGMIRNILEVLMESTPRE--ID
P.trichocarpa_XI272          IQSFGVMLGGALIWYKPGWKIIDLICTLVFSIIVLGTTISMLRNILEVLMESTPRE--ID
```

FIGURE 6 (continued)

```
A.thaliana_AT2G04620          LKEAMRNILKTKGVCSIQRLHVWSFTNSDVVATLHLLVSADSDKTDTKLQVSRLLED-AG
P.tricornutum_23557           WQDVYDDLSELESLTKVHDLHIWCISDGVTVVSLHASAV-DGHVDQALRDVNRVCQK-HK
A.thaliana_AT2G29410          IEKLERGLKRIDGVKIVYDLHVWEITVGRIVLSCHILPEPGASPKEIITGVRNFCRKSYG
V.vinifera_GSVIVT24226001     IAGLENGLKSIKGVQDVHDLHVWAITVGKVVMSCHVIAEPGATSSEILGDIRDYCEKTYR
P.patens_119800               AQEVQYGLNELPNVVAIHELHIWALTIGKTLLTCHIQVSPNANYDEVLQNVVDYLEIKFK
P.patens_58387                AQAVERGLLGLPGVVEVHDLHIWAITVGKTLLACHIRVQPQVNTNEALQAVADYCERVFK
C.tinctorius_TA2425           ATSLERGLCEINEVVAIHGLHIWAITVGKVLLACHVRIRREADADMVLDKVVDYIKREYN
O.sativa_Os05g03780           ATSLENGLRDMDGVVAVHELHIWAITVGKVLLACHVTITQDADADQMLDKVIGYIKSEYN
Z.mays_TA176521               ATRLERGLCEMEGVVAVHELHIWAITVGKVLLACHVTVAREADADEILDKVIGYIKTEYN
E.grandis_AF197329            ATRLESGLCKMDEVIAVHELHIWAITVGKVLLACHVKIKRDANADMVLDKVVDYIRREYK
I.nil_TA6615                  ATRLEQGLCEMEEVVAVHELHIWAITVGKVLLACHVKIKKEADADIVLDKVIDYIKTEYN
N.benthamiana_TA8245          ATRLEKGLCEMEDVVTIHELHIWAITVGKVLLACHVKIKPDADADTVLDKVIDYIKREYN
N.tabacum_TA14631             ATRLEKGLCEMEDVVAIHELHIWAITVGKVLLACHVKIKSDADADTVLDKVIDYIKREYN
P.trichocarpa_II672           ATKIEKGLFEMEDVVAIHELHIWAITVGKILLACHVKIRPEANADMVLDNLINYIRSEYS
P.trichocarpa_XIV.515         ATKIEKGLLEMEEVMAIHELHIWAITVGKILLACHVKIMPEANADMVLDNVISYLRREYN
A.thaliana_AT3G61940          ARQLEKGLMEIEEVVDVHELHIWAITVGKALFSCHVKVRPEAGDEMVLNKVIDYIWREYR
A.thaliana_AT2G46800          ATKLEKGLLEMEEVVAVHELHIWAITVGKVLLACHVNIRPEADADMVLNKVIDYIRREYN
T.caerulescens_TA62           ATKLEKGLLEMEEVVAVHELHIWAITVGKVLLACHVNVTPQADADMVLNKVVDYIRREYN
A.thaliana_AT3G58810          PTMLEKGVCEIEEVVAIHELHIWAITVGKLLLACHVKIRPEAEADMVLDKIIDYIKREHN
P.trichocarpa_I910            ATRLEKGLCEMDEVVAIHELHIWAITVGKFLLACHVMIKPDADADMVLDKVIDYIRREHN
P.trichocarpa_XI272           ATTLEKGLCEMDEVVAVHELHIWAITVGKFLLACHVMIKPDADADMVLDKVIDYIKREHN A.thaliana_AT2G04620          VKDWTLQVESVNS---------------
P.tricornutum_23557           LQHITAQLQTASVEECITCTQSNLNCKS
A.thaliana_AT2G29410          IYHATVQVESE-----------------
V.vinifera_GSVIVT24226001     ILHVTVQVE-------------------
P.patens_119800               ITHTTIQIESRI----------------
P.patens_58387                ISHVTIQVETDS----------------
C.tinctorius_TA2425           ISHVTIQIERE-----------------
O.sativa_Os05g03780           ISHVTIQIERE-----------------
Z.mays_TA176521               ISHVTIQVERE-----------------
E.grandis_AF197329            ISHVTIQVERE-----------------
I.nil_TA6615                  ITHVTIQIERE-----------------
N.benthamiana_TA8245          ISHVTIQIERE-----------------
N.tabacum_TA14631             ISHVTIQIERE-----------------
P.trichocarpa_II672           ISHVTIQIER------------------
P.trichocarpa_XIV.515         ISHVTIQIER------------------
A.thaliana_AT3G61940          ISHVTIQIER------------------
A.thaliana_AT2G46800          ISHVTIQIER------------------
T.caerulescens_TA62           ISHVTIQIER------------------
A.thaliana_AT3G58810          ISHVTIQIERQ-----------------
P.trichocarpa_I910            ITHVTIQIERP-----------------
P.trichocarpa_XI272           ISHVTIQIERQ-----------------
```

FIGURE 6 (continued)

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2009/058942, filed Jul. 14, 2009, which claims benefit of European application 08160636.0, filed Jul. 17, 2008; European Application 08160752.5, filed Jul. 18, 2008; U.S. Provisional Application 61/081,823, filed Jul. 18, 2008; U.S. Provisional Application 61/082,239, filed Jul. 21, 2008; U.S. Provisional Application 61/084,641, filed Jul. 30, 2008; European Application 08161407.5, filed Jul. 30, 2008; European Application 08162611.1, filed Aug. 19, 2008; U.S. Provisional Application 61/089,927, filed Aug. 19, 2008; European Application 08169818.5, filed Nov. 24, 2008 and U.S. Provisional Application 61/119,809, filed Dec. 4, 2008.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_074053_0046. The size of the text file is 860 KB, and the text file was created on Sep. 29, 2014.

The present invention relates generally to the field of molecular biology and concerns a method for enhancing yield-related traits by modulating expression in a plant of a nucleic acid encoding an MSR (Methionine_Sulfoxide_Reductase). The present invention also concerns plants having modulated expression of a nucleic acid encoding a MSR, which plants have enhanced yield-related relative to corresponding wild type plants or other control plants. The invention also provides constructs useful in the methods of the invention.

Furthermore, the present invention relates generally to the field of molecular biology and concerns a method for enhancing yield-related traits by modulating expression in a plant of a nucleic acid encoding an Enolase. The present invention also concerns plants having modulated expression of a nucleic acid encoding an Enolase, which plants have enhanced yield-related traits relative to corresponding wild type plants or other control plants. The invention also provides constructs useful in the methods of the invention.

Even furthermore, the present invention relates generally to the field of molecular biology and concerns a method for enhancing various yield-related traits in plants by modulating expression in a plant of a nucleic acid encoding a ZAT-like zinc transporter. The present invention also concerns plants having modulated expression of a nucleic acid encoding a ZAT-like zinc transporter, which plants have enhanced yield-related traits relative to corresponding wild type plants or other control plants. The invention also provides constructs useful in the methods of the invention.

Yet furthermore, the present invention relates generally to the field of molecular biology and concerns a method for improving various plant growth characteristics by modulating expression in a plant of a nucleic acid encoding 6-PGDH (6-phosphogluconate dehydrogenase or 6-phosphogluconate dehydrogenase) polypeptide. The present invention also concerns plants having modulated expression of a nucleic acid encoding a 6-PGDH polypeptide, which plants have improved growth characteristics relative to corresponding wild type plants or other control plants. The invention also provides constructs useful in the methods of the invention.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (Zea mays L.) hybrids based on Corn Belt germplasm in the European Atlantic.

A further important trait is that of improved abiotic stress tolerance. Abiotic stress is a primary cause of crop loss worldwide, reducing average yields for most major crop plants by more than 50% (Wang et al., Planta (2003) 218: 1-14). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors.

Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defense mechanisms.

Concerning MSR polypeptides, it has now been found that various yield-related traits may be improved in plants by modulating expression in a plant of a nucleic acid encoding an MSR (Methione Sulfoxide Reductase) in a plant.

Concerning enolase polypeptides, it has now been found that various yield-related traits may be improved in plants by modulating expression in a plant of a nucleic acid encoding an Enolase in a plant.

Concerning ZAT-like zinc transporter polypeptides, it has now been found that yield-related traits may be enhanced in plants by modulating expression in a plant of a nucleic acid encoding a ZAT-like zinc transporter in a plant.

BACKGROUND

1. Methionine Sulfoxide Reductase (Msr)

Oxygen is essential to all aerobic organisms but can also have many harmful effects. Oxidation of Methione residues in a protein or a peptide has been implicated in several serious conditions in humans, including adult respiratory distress syndrome, rheumatoid arthritis, smokers' emphysema, and Alzheimer's disease. There is now growing evidence that enzymatic repair of oxidized Methione residues may play a key protective role in organisms ranging from bacteria to humans (El Hassouni Proc Natl Acad Sci USA. 1999; 96:887-892). In addition to being the most common form of oxidative damage to proteins, the oxidation of Methione to Methionine sulfoxide (MetSO) is unique in being readily reversible by the enzyme peptide-Met sulfoxide reductase (MSR; EC 1.8.4.11), suggesting that MSR may be able to repair oxidatively damaged proteins (Brot et al. Anal Biochem. 1982 b; 122:291-294) in vivo.

The methionine sulfoxide reductase (Msr) family is composed of two monomeric enzymes named MsrA and MsrB, which reduce oxidised methionine residues in a peptide (peptide-L-methionine (S)—S-oxide). MsrA and Msr B display specific stereo-selectivities towards the sulfoxide. Both isoforms contribute and are necessary to protect the cell against the stress caused by the oxidation of Met residues at the sulfur atom which typically present a racemic mixture of the two stereoisomers.

Additionally, MsrA and MsrB types share the same chemical reaction mechanism which includes three steps with (1) formation of a sulfenic acid intermediate with a concomitant release of 1 mol of methionine per mol of enzyme; (2) formation of an intramonomeric disulfide Msr bond followed by; (3) reduction of the oxidized Msr by thioredoxin (Trx). The active sites of both Msrs are adapted for binding protein-bound methionine sulfoxide (MetSO) more efficiently than free MetSO (Boschi-Muller, et al. Biochim. Biophys. Acta (2005); 1703: 231-238; Boschi-Muller et al. 2008, Arch Biochem Biophys. 15; 474(2):266-73). In a number of bacteria, the MSRA and MSRB domains are fused (Kryukov et al. 2002 PNAS 99:4245-4250).

In plant cells, several MSR protein isoforms both of the A and B type are present. The isoforms may be localized to different subcellular compartment such as cytosol, chloroplast or secretory pathway. Phylogenetic analysis revealed that the A and B type have evolved such that two MSR-A and MSR-B subgroups can be distinguished. They differ essentially in the number and in the position of the cysteines involved in catalysis and enzyme regeneration, but also in the subcellular localization or in the intron/exon distribution of the gene encoding the isoform. MSR-A and MSR-B isoforms contribute to a total MSR enzymatic activity in plant cells as measured by Sanchez at al. 1983 Plant Physiol 73:619-623; Bechtold et al. 2004, Plant Cell 16:908-919. Functionally, the plant MSRs, A and B type included, appear to constitute key components in preventing damage in proteins under severe environmental constraints known to generate-ROS in plastids (Romero et al. 2004 Plant Physiol 136:3784-3794), or under pathogen infection (Sanchez et al. 1983), but also under more subtle treatments such as long night periods (Bechtold et al. 2004).

2. Enolase (2-phospho-D-glycerate hydrolase)

Enolase (2-phospho-D-glycerate hydrolase) is an essential glycolytic enzyme that catalyses the interconversion of 2-phosphoglycerate and phosphoenol-pyruvate. Genes encoding Enolase proteins are conserved from prokaryotes to eukaryotes. In vertebrates, isoenzymes alpha, beta and gamma are present: alpha is present in most tissues; beta is localised in muscle tissue; and gamma is found only in nervous tissue. The functional enzyme exists as a dimer of any 2 isoforms: in immature organs and in adult liver, it is usually an alpha homodimer; in adult skeletal muscle, a beta homodimer; and in adult neurons, a gamma homodimer; in developing muscle, it is usually an alpha/beta heterodimer; and in the developing nervous system, an alpha/gamma heterodimer. The tissue specific forms display minor kinetic differences. In plants levels of Enolase transcripts and activity reportedly increased in response to abiotic stresses such as salt, low and high temperature, and anaerobic stresses (Forsthoefel, et al. 1995; Plant Physiol. 108(3): 1185-1195). In animal cells, Enolase has also been known to function as a transcription factor that represses the expression of c-myc by binding to the c-myc gene promoter.

In higher plants, Enolase, like other glycolytic enzymes, is present as multiple isoforms localized to the cytosol and to plastids. In addition to its essential role in glycolysis and gluconeogenesis, in plants, Enolase plays specialized roles in processes with high demand for carbon flux through glycolysis such as fruit ripening (Van Der Straeten et al., 1991; Plant Cell, 3: 719-735) and growth under conditions of anaerobiosis. Exposure of plants to anaerobic stress causes a shift from an oxidative to a fermentative mode of carbohydrate metabolism, resulting in the increased expression of many enzymes of the glycolytic pathway (Lal et al; 1998 Plant Physiol. 1998 December; 118(4):1285-93).

In animal cells, part of the Enolase protein has been shown to bind to the promoter element of the c-myc gene and to repress c-myc expression (Subramanian et al., 2000; J. Biol. Chem., 275: 5958-5965). Similarly a plant derived Enolase protein, the LOS2 protein, can bind to the c-myc promoter as well as to the promoter of the zinc finger STZ/ZAT10 from *Arabidopsis*. The characteristic DNA binding and repressor protein domains of Enolases are conserved between the human alpha-Enolase and the *Arabidopsis* LOS2 Enolase. The LOS2 Enolase protein has been suggested to play a role in controlling gene expression under low temperature stress in *Arabidopsis thaliana* (Lee et al. 2002; EMBO J. 21(11): 2692-2702). The *Arabidopsis thaliana* los2 mutant plants reportedly displayed chilling and freezing sensitivity.

3. Zn Transporter of *Arabidopsis thaliana* (ZAT)

Van der Zaal et al., (Plant Physiology, March 1999, Vol. 119, pp. 1047-1055) describe a ZAT zinc transporter (the term ZAT being derived from Zn transporter of *Arabidopsis thaliana*) of 398 amino acid residues and predicted to have six membrane-spanning domains. The authors analyzed transgenic plants containing the *Arabidopsis thaliana* ZAT coding sequence under the control of the cauliflower mosaic virus 35S promoter. Plants obtained with ZAT in the sense orientation reportedly exhibited enhanced Zn resistance and strongly increased Zn content in the roots under high Zn exposure. Antisense mRNA-producing plants were reported to be viable, with a wild-type level of Zn resistance and content, like plants expressing a truncated coding sequence lacking the C-terminal domain of the protein.

Ramesh et al., (Plant Molecular Biology 54: 373-385, 2004) describe the effects of overexpression of the *Arabidopsis* zinc transporter AtZIP1 in *Hordeum vulgare* cv. Golden Promise on plant growth, seed mineral content and zinc transport rates. The authors reported that in the long-term growth experiments there were no significant differences between transgenic and control lines in leaf zinc content or shoot biomass under zinc-sufficient or zinc-deficient conditions. Root-to-shoot ratios were reported to be higher in the transgenic plants grown under low zinc conditions.

Since the ZIP-type zinc transporters described in Ramesh et al. did not give any significant differences between transgenic and control lines in leaf zinc content or shoot biomass under zinc-sufficient or zinc-deficient conditions, it was surprising to find that ZAT-like zinc transporters gave enhanced yield-related traits upon modulating expression in a plant of a ZAT-like zinc transporter.

4. 6-Phosphogluconate Dehydrogenase (6-PGDH)

6-Phosphogluconate dehydrogenase (EC: 1.1.1.44) (6-PGDH) is an oxidative carboxylase that catalyses the decarboxylating reduction of 6-phosphogluconate into ribulose 5-phosphate in the presence of NADP. This enzyme contributes to generate a significant amount of reducing power (NADPH) in the a cell. This reaction is a component of the hexose mono-phosphate shunt and pentose phosphate pathways (PPP) Broedel and Wolf J. Bacteriol. 172 4023-4031 1990. Prokaryotic and eukaryotic 6PGD are proteins of about 470 amino acids whose sequence are highly conserved Adams et al. EMBO J. 2 1009-1014 1983. The protein is a homodimer in which the monomers act independently: each contains a large, mainly alpha-helical domain and a smaller beta-alpha-beta domain, containing a mixed parallel and antiparallel 6-stranded beta sheet. NADP is bound in a cleft in the small domain, the substrate binding in an adjacent pocket.

SUMMARY

1. Methionine Sulfoxide Reductase (Msr)

Surprisingly, it has now been found that modulating expression of a nucleic acid encoding an MSR polypeptide gives plants having enhanced yield-related traits relative to control plants.

According one embodiment, there is provided a method for enhancing yield-related traits relative to control plants, comprising modulating expression of a nucleic acid encoding an MSR polypeptide in a plant.

2. Enolase (2-phospho-D-glycerate hydrolase)

Surprisingly, it has now been found that modulating expression of a nucleic acid encoding an Enolase polypeptide gives plants having enhanced yield-related traits relative to control plants.

According one embodiment, there is provided a method for enhancing yield-related traits relative to control plants, comprising modulating expression of a nucleic acid encoding an Enolase polypeptide in a plant.

3. Zn Transporter of *Arabidopsis thaliana* (ZAT)

It has now surprisingly been found that modulating expression of a nucleic acid encoding a ZAT-like zinc transporter polypeptide gives plants having enhanced yield-related traits, in particular increased yield relative to control plants.

According one embodiment, there is provided a method for enhancing plant yield-related traits relative to control plants, comprising modulating expression in a plant of a nucleic acid encoding a ZAT-like zinc transporter polypeptide in a plant.

4. 6-Phosphogluconate Dehydrogenase (6-PGDH)

Surprisingly, it has now been found that modulating expression of a nucleic acid encoding a 6-PGDH (6-phosphogluconate dehydrogenase or 6-phosphogluconate dehydrogenase) polypeptide, gives plants having enhanced yield-related traits relative to control plants.

According one embodiment, there is provided a method for improving yield related traits of a plant relative to control plants, comprising modulating expression of a nucleic acid encoding a 6-PGDH (6-phosphogluconate dehydrogenase or 6-phosphogluconate dehydrogenase) polypeptide. The improved yield related traits comprised one or more of increased biomass, increased early vigour, and increased seed yield.

DEFINITIONS

Polypeptide(s)/Protein(s)

The terms "polypeptide" and "protein" are used interchangeably herein and refer to amino acids in a polymeric form of any length, linked together by peptide bonds.

Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag•100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions | Residue | Conservative Substitutions |
|---|---|---|---|
| Ala | Ser | Leu | Ile; Val |
| Arg | Lys | Lys | Arg; Gln |
| Asn | Gln; His | Met | Leu; Ile |
| Asp | Glu | Phe | Met; Leu; Tyr |
| Gln | Asn | Ser | Thr; Gly |
| Cys | Ser | Thr | Ser; Val |
| Glu | Asp | Trp | Tyr |
| Gly | Pro | Tyr | Trp; Phe |
| His | Asn; Gln | Val | Ile; Leu |
| Ile | Leu, Val | | |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

Motif/Consensus Sequence/Signature

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5° C. + 16.6 \times \log_{10}[Na^+]^a + 0.41 \times \%[G/C^b] - 500 \times [L^c]^{-1} - 0.61 \times \% \text{ formamide}$$

2) DNA-RNA or RNA-RNA hybrids:

$$Tm = 79.8 + 18.5(\log_{10}[Na^+]^a) + 0.58(\%G/C^b) + 11.8 (\%G/C^b)^2 - 820/L^c$$

3) oligo-DNA or oligo-RNA$^d$ hybrids:

For <20 nucleotides: $T_m = 2(I_n)$

For 20-35 nucleotides: $T_m = 22 + 1.46(I_n)$ $^a$ or for other monovalent cation, but only accurate in the 0.01-0.4 M range.
$^b$ only accurate for % GC in the 30% to 75% range.
$^c$ L=length of duplex in base pairs.
$^d$ oligo, oligonucleotide; $I_n$,=effective length of primer=2× (no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, $3^{rd}$ Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about $\frac{1}{10,000}$ transcripts to about $\frac{1}{100,000}$ transcripts, to about $\frac{1}{500,0000}$ transcripts per cell. Conversely, a "strong promoter" drives expression of a coding sequence at high level, or at about $\frac{1}{10}$ transcripts to about $\frac{1}{100}$ transcripts to about $\frac{1}{1000}$ transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic Acids Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
|---|---|
| RCc3 | Plant Mol Biol. 1995 Jan; 27(2): 237-48 |
| Arabidopsis PHT1 | Kovama et al., 2005; Mudge et al. (2002, Plant J. 31: 341) |
| Medicago phosphate transporter | Xiao et al., 2006 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Plant Mol. Biol. 16, 983, 1991. |
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant Mol. Biol. 21: 109-119, 1993. |

TABLE 2b-continued

Examples of root-specific promoters

| Gene Source | Reference |
|---|---|
| LRX1 | Baumberger et al. 2001, Genes & Dev. 15: 1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2; 1Np (N. plumbaginifolia) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
|---|---|
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley ltr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |
| maize ESR gene family | Plant J 12: 235-46, 1997 |
| sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |

TABLE 2c-continued

Examples of seed-specific promoters

| Gene source | Reference |
| --- | --- |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
| --- | --- |
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| sorghum kafirin | DeRose et al. (1996) Plant Mol Biol 32: 1029-35 |

TABLE 2e

Examples of embryo specific promoters:

| Gene source | Reference |
| --- | --- |
| rice OSH1 | Sato et al, Proc. Natl. Acad. Sci. USA, 93: 8117-8122, 1996 |
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters:

| Gene source | Reference |
| --- | --- |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2g below.

TABLE 2g

Examples of green tissue-specific promoters

| Gene | Expression | Reference |
| --- | --- | --- |
| Maize Orthophosphate dikinase | Leaf specific | Fukayama et al., 2001 |
| Maize Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2h below.

TABLE 2h

Examples of meristem-specific promoters

| Gene source | Expression pattern | Reference |
| --- | --- | --- |
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994).

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants. Methods for decreasing expression are known in the art and the skilled person would readily be able to adapt the known methods for silencing so as to achieve reduction of expression of an endogenous gene in a whole plant or in parts thereof through the use of an appropriate promoter, for example.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

Examples of various methods for the reduction or substantial elimination of expression in a plant of an endogenous gene, or for lowering levels and/or activity of a protein, are known to the skilled in the art. A skilled person would readily be able to adapt the known methods for silencing, so as to achieve reduction of expression of an endogenous gene in a whole plant or in parts thereof through the use of an appropriate promoter, for example.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. mRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or β-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die). The marker genes may be removed or excised from the transgenic cell once they are no longer needed. Techniques for marker gene removal are known in the art, useful techniques are described above in the definitions section.

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with Agrobacteria, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.
Transgenic/Transgene/Recombinant For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either
  (a) the nucleic acid sequences encoding proteins useful in the methods of the invention, or
  (b) genetic control sequence(s) which is operably linked with the nucleic acid sequence according to the invention, for example a promoter, or
  (c) a) and b)
are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol. Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

Tilling

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N.J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offringa et al. (1990) EMBO J. 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increase/Improve/Enhance

The terms "increase", "improve" or "enhance" are interchangeable and shall mean in the sense of the application at least a 3%, 4%, 5%, 6%, 7%, 8%, 9%, or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), and g) increased number of primary panicles, which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased seed yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena fatua* var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum integrifolium* or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Tripsacum dactyloides*, *Triticale* sp., *Triticosecale rimpaui*, *Triticum* spp. (e.g. *Triticum aestivum*, *Triticum durum*, *Triticum turgidum*, *Triticum hybernum*, *Triticum macha*, *Triticum sativum*, *Triticum monococcum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

DETAILED DESCRIPTION OF THE INVENTION

Surprisingly, it has now been found that modulating expression in a plant of a nucleic acid encoding an MSR polypeptide gives plants having enhanced yield-related traits relative to control plants. According to a first embodiment, the present invention provides a method for enhancing yield-related traits in plants relative to control plants, comprising modulating expression in a plant of a nucleic acid encoding an MSR polypeptide and optionally selecting for plants having enhanced yield-related traits.

Furthermore, surprisingly, it has now been found that modulating expression in a plant of a nucleic acid encoding an Enolase polypeptide gives plants having enhanced yield-related traits relative to control plants. According to a first embodiment, the present invention provides a method for enhancing yield-related traits in plants relative to control plants, comprising modulating expression in a plant of a nucleic acid encoding an Enolase polypeptide.

Concerning enolase polypeptides, advantageously, the invention also provides hitherto unknown nucleic acid sequences encoding Enolase polypeptides.

According to a further embodiment of the present invention, there is therefore provided an isolated nucleic acid molecule selected from:
(i) a nucleic acid represented by any one of SEQ ID NO: 215 and 217;
(ii) the complement of a nucleic acid represented by any one of SEQ ID NO: 215 and 217;
(iii) a nucleic acid encoding the polypeptide as represented by any one of SEQ ID NO: 216 and 218, preferably as a result of the degeneracy of the genetic code, said isolated nucleic acid can be derived from a polypeptide sequence as represented by any one of SEQ ID NO: 216 and 218 and further preferably confers enhanced yield-related traits relative to control plants;
(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A2 and further preferably conferring enhanced yield-related traits relative to control plants;
(v) a nucleic acid molecule which hybridizes with a nucleic acid molecule of (i) to (iv) under stringent hybridization conditions and preferably confers enhanced yield-related traits relative to control plants;
(vi) a nucleic acid encoding a Enolase polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 216 and 218 and any of the other amino acid sequences in Table A2 and preferably conferring enhanced yield-related traits relative to control plants.

According to a further embodiment of the present invention, there is also provided an isolated polypeptide selected from:
(i) an amino acid sequence represented by any one of SEQ ID NO: 216 and 218;
(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 216 and 218 and any of the other amino acid sequences in Table A2 and preferably conferring enhanced yield-related traits relative to control plants.
(iii) derivatives of any of the amino acid sequences given in (i) or (ii) above.

Even furthermore, surprisingly, it has now been found that modulating expression in a plant of a nucleic acid encoding a ZAT-like zinc transporter polypeptide gives plants having enhanced yield-related traits relative to control plants. According to a first embodiment, the present invention provides a method for enhancing yield-related traits in plants relative to control plants, comprising modulating expression in a plant of a nucleic acid encoding a ZAT-like zinc transporter polypeptide.

Yet furthermore, surprisingly, it has now been found that modulating expression in a plant of a nucleic acid encoding a 6-PGDH (6-phosphogluconate dehydrogenase or 6-phosphogluconate dehydrogenase) polypeptide, gives plants having enhanced yield-related traits relative to control plants. According to a first embodiment, the present invention provides a method for enhancing yield-related traits in plants relative to control plants, comprising modulating expression in a plant of a nucleic acid encoding a 6-PGDH polypeptide and optionally selecting for plants having enhanced yield-related traits.

Concerning MSR polypeptides, a preferred method for modulating (preferably, increasing) expression of a nucleic acid encoding an MSR polypeptide is by introducing and expressing in a plant a nucleic acid encoding an MSR polypeptide. The increase in expression is in increasing order of preference more than 1, 2, 3, 4, 5, 6, 7, 8, 9, 10, 15, 20, 25, 30, 35, 40, 45, 50, 60, 70, 80, 90, 100 times the level of expression of the same and/or the homologous nucleic acid encoding an MSR polypeptide in a control. Methods to measure the expression level of a gene are well known in the art (Sambrook et al. 1989; John Wiley & Sons 1989 and yearly updates).

Concerning enolase polypeptides, a preferred method for modulating (preferably, increasing) expression of a nucleic acid encoding an Enolase polypeptide is by introducing and expressing in a plant a nucleic acid encoding an Enolase polypeptide.

Concerning ZAT-like zinc transporter polypeptides, a preferred method for modulating (preferably, increasing) expression of a nucleic acid encoding a ZAT-like zinc transporter polypeptide is by introducing and expressing in a plant a nucleic acid encoding a ZAT-like zinc transporter polypeptide.

Concerning 6-PGDH polypeptides, a preferred method for modulating (preferably, increasing) expression of a nucleic acid encoding a 6-PGDH polypeptide is by introducing and expressing in a plant a nucleic acid encoding a 6-PGDH polypeptide.

Concerning MSR polypeptides, any reference hereinafter to a "protein useful in the methods of the invention" is taken to mean an MSR polypeptide as defined herein. Any reference hereinafter to a "nucleic acid useful in the methods of the invention" is taken to mean a nucleic acid capable of encoding such an MSR polypeptide. The nucleic acid to be introduced into a plant (and therefore useful in performing the methods of the invention) is any nucleic acid encoding the type of protein which will now be described, hereafter also named "MSR nucleic acid" or "MSR gene".

Concerning enolase polypeptides, any reference hereinafter to a "protein useful in the methods of the invention" is taken to mean an Enolase polypeptide as defined herein. Any reference hereinafter to a "nucleic acid useful in the methods of the invention" is taken to mean a nucleic acid capable of encoding such an Enolase polypeptide. The nucleic acid to be introduced into a plant (and therefore useful in performing the methods of the invention) is any nucleic acid encoding the type of protein which will now be described, hereafter also named "ENOLASE nucleic acid" or "ENOLASE gene".

Concerning ZAT-like zinc transporter polypeptides, any reference hereinafter to a "protein useful in the methods of the invention" is taken to mean a ZAT-like zinc transporter polypeptide as defined herein. Any reference hereinafter to a "nucleic acid useful in the methods of the invention" is taken to mean a nucleic acid capable of encoding such a ZAT-like zinc transporter polypeptide. The nucleic acid to be introduced into a plant (and therefore useful in performing the methods of the invention) is any nucleic acid encoding the type of protein which will now be described, hereafter also named "ZAT-like zinc transporter nucleic acid" or "ZAT-like zinc transporter gene".

Concerning 6-PGDH polypeptides, any reference hereinafter to a "protein useful in the methods of the invention" is taken to mean a 6-PGDH polypeptide as defined herein. Any reference hereinafter to a "nucleic acid useful in the methods of the invention" is taken to mean a nucleic acid capable of encoding such a 6-PGDH polypeptide. The nucleic acid to be introduced into a plant (and therefore useful in performing the methods of the invention) is any nucleic acid encoding the type of protein which will now be described, hereafter also named "6-PGDH nucleic acid" or "6-PGDH gene".

A "MSR polypeptide" as defined herein refers to any polypeptide having in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more amino acid sequence identity to any of the polypeptide sequences given in Table A1 herein and preferably having methione sulfoxide reductase activity.

Preferably an MSR polypeptide useful in the methods of the invention comprises at least one conserved protein motif having in increasing order of preference 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to any one of:

(i) Motif 1 as represented by SEQ ID NO: 173: (Q)(Y)(R)(S);
(ii) Motif 2 as represented by SEQ ID NO: 174 (Y/H/E/D/G)(H/S)(Q/R) (Q/K/R)(Y/F)(L/C/E);
(iii) Motif 3 as represented by SEQ ID NO: 175 (I/V)(V/M/I/A/R/F/T)(T/V/R) (E/D/T)(I/V/I/Q I/V/Q)(L/K/A/V/I)(P/G/T/K)(A/S/P/T/Q);
(iv) Motif 4 as represented by SEQ ID NO: 176 (A/F/T/-)(Q/V/E/S/C/T/-)(F/I/A/-)(G/A/-)(A/L/S/T/-)(G/-)(C/S/-)(F/-)(W/-) (G/R/S/-)(V/S/G/-)(E/-)(L/-)(A/M/G/V/T/-)(F/C/A/Y/-) (Q/W/R/G/-)(R/C/E/-)(V/I/L/S/A/-)(P/H/R/N/S/-)(G/-)(V/L/-)(T/V/I/Y/R/A/-)(K/R/E/S/A/Y/Q/V/-)(T/A/-) (E/S/R/A/-)(V/A/-)(G/-)(Y/-)(T/S/A/V/I/-)(Q/G/A/H/-)(G/-)(N/S/L/H/K/A/D/Q/-)(L/K/S/T/I/V/F/R/M/-(H/T/A/S/Q/K/E/P/D/-)(N/D/H/R/G/E/M/-)(P/-)(T/S/L/N/D/-(Y/-)(E/R/K/Y/G/Q/-)(D/A/L/-)(V/E/D/A/I/-)(C/Y/-(T/S/R/H/G/-)(G/N/S/-)(A/L/V/Q/R/K/T/D/M/-)(T/G/A/-(Y/D/G/N/S/K/-)(H/-)(S/A/T/V/N/M)(E/Q) (V/S/F/A/G/C)(V/L/D)(R/Q/E/K/Y)(V/I/L/M)(Q/H/E/T/V/I)(Y/F)(D/N)(P/V/L)(K/R/S/Q/A/N)(A/V/L/I/M/Q/E/D/N)(C/I/V/G)(K/P/K/T/G/Q/H)(Y/F)(D/R/S/K/T/E/Q)(D/Q/K/N/T/V/S)(L/I)(L/V)(D/E/S/A/K)(V/F/I/L/M/A/T)(F/H/L)(W/Y)(A/S/Q/K/T/D/N)(R/K/S/M/N)(H)(D/N)(P/S)(T/R)(T/Q/E/A)(L/P/V/I/G/K/F)(N/F/H/M/D)(R/G)(Q)(G/V)(N/P/G/A/E)(D/L)(V/Q/R/L/S)(G)(T/N/A/S/P)(Q)(Y)(R)(S)(G/V/A/C/I)(I/V/L)(Y/F)(Y/T/F/C)(Y/V/H/Q/T/S);

wherein the amino acid at each position is given between brackets and - represents a gap, that is, the absence of an amino acid at said position.

Alternatively an MSR polypeptide useful in the methods of the invention comprises a protein motif having at least in increasing order of preference 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to one or more of the following motifs:

(i) Motif 5 as represented by SEQ ID NO: 177: (G)(W)(P)
(ii) Motif 6 as represented by SEQ ID NO: 178: (L/V)(Y/F/L) (K/D/E/Q/S/R)(S/T/)(T/S/A/I/L/K/D/-)(T/A/-) (K/-)(F/-) (D/N/-)(S/A/R)(G/P)
(iii) Motif 7 as represented by SEQ ID NO: 179: (G/D/E/N/-)(G/A/S/I/-)(H/F/-)(L/F/-)(G/F/C/-)(H/F)(V/I/S)(F/T/H/L/V) (K/D/P/M/L/I/R)
(iv) Motif 8 as represented by SEQ ID NO: 180: (K/R/L/T/W/L/F/I/-)(S/T/R/Q/P/K/G/-)(E/D/N/A/T/K/-)(E/A/Q/A/G/R/-)(E/D/R/-)((W/L/Q/-)(R/K/A/V/E/Q/-)(A/V/K/T/Q/R/-)(V/I/Q/R/K/G/-)(L/A/-)(S/T/E/N/-)(P/D/S/Q/A/N/E/K/-)(E/D/Q/A/-)(Q/E/A)(F/Y/R/-)(R/Y/H/K/T/Q/-)(I/V/-)(L/T/A/-)(R/L/-)(Q/K/L/D/R/E/H/-)(K/A/E/H/-)(G/M/S/A)(T/I/S) (E/D/R)(R/A/K/N/Y/T/I/P/F/L)(P/A/K/Q/R/A)(G/F/N)(T/S/K/C)(G/S/E)(E/P/V/R)(Y/F/L) (N/D/W/V/T/L/E)(K/N/Q/D)(F/T/N/V/L/K/E/S)(F/W/Y/K/H/D/S)(T/N/A/G/E/D/K/R)(E/P/A/D/K/Q/V)(G)(I/V/A/T)(Y/F)
(v) Motif 9 as represented by SEQ ID NO: 181: (C)(A/V/I/R)(G/C/L)(C)(G/A/D/N/K/Q/E) (T/S/A/L/N)(P/A/D/K)(L/V)(Y/F/L)(K/E/D/Q/S/R)(S/-)(T/S/K/D/A/I/L)
(vi) Motif 10 as represented by SEQ ID NO: 182: (A/S)(F/Y)(F/Y/W/D)(E/Q/D/R/A) (G/P/T/A)(I/V/L/F)(G/P/A/D)(G/A/P/N/D/K/E)(A/N/T)(I/V/H)(N/K/T/G/V/I/A)(R/Q/S/E/T)(T/K/H/I/E/A/S/N)(P/L/R/T/A/M/V/I/E)

(D/E/R/I/G/N)(P/L/A/D/R/W/M)(D/E/S/T/A/G/-)(G/I/S/F/H/-)(R/I/F/P/G/H/L/K/M/-)(R/F/S/G/M/-)(M/V/Y/I/T/-)(P/R/V/-)(R/-)(Q/T/-) (E/A/-)(I/V/S/T/-)(T/L/I/V/H/N/-)(C/-)
(vii) Motif 11 as represented by SEQ ID NO: 183: (G/A/S/I/-)(H/F/-)(L/F/-)(G/F/C/-)(H/F) (V/I/S)(F/T/H/L/V)(K/D/P/M/L/I/R) (G/D/N/T/V)(E/G/R/H)(G/P/N/D/W/S) (F/P/H/Y/I/N/R/S)(S/L/P/A/D/G/K/R-)(T/R/N/V/-)(P/D/A/F/T/-)(T/L/F/S/R)(D/G/L/Y/N)(E/K/A/N/Q/L)(R/K/D/E/A/P)(H/Y/I/L/K/C/F)(C/V/-)(V/L/I/S/M/-)(N/Q/K/L/-)(S/L/Q/R/-)(V/I/A/R/Y/-)

Motifs 1 to 11 further comprise a sequence as represented by SEQ ID NO: 173 to 183 respectively, in which any amino acid residue is substituted by any conservative amino acid residues according to Table 1.

Motifs 1 to 4 are typically present in MSR polypeptides of the type A, while Motifs 5 to 11 are characteristic of MSR polypeptide of the type B.

Preferably, the homologue of an MSR protein has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 2 or SEQ ID NO: 102, provided that the homologous protein comprises a conserved motifs as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

A Methione Sulfoxide Reductase Enzyme having the systematic name "peptide-L-methionine:thioredoxin-disulfide S-oxidoreductase [L-methionine (S)—S-oxide-forming]" catalyses the reduction of peptides having oxidised methione residues mediated by thioredoxin. MSR enzymes are able to catalyze any of the following reactions:

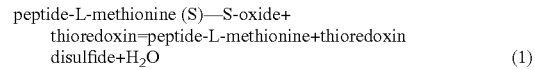

$$\text{peptide-L-methionine (S)—S-oxide+} \\ \text{thioredoxin=peptide-L-methionine+thioredoxin} \\ \text{disulfide+H}_2\text{O} \qquad (1)$$

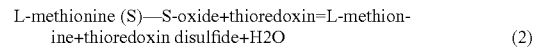

$$\text{L-methionine (S)—S-oxide+thioredoxin=L-methionine+thioredoxin disulfide+H2O} \qquad (2)$$

Preferably, the MSR polypeptide sequence useful in the methods of the invention is a polypeptide which when used in the construction of a phylogenetic tree, such as the one depicted in FIG. 2 of Rouhier et al. 2006, clusters with the group of AtMSRB1 or OsMSRA4 polypeptides rather than with any other group.

An "Enolase polypeptide" as defined herein refers to any polypeptide comprising a protein domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% amino acid sequence identity to (i) a Conserved Enolase N Domain as represented by SEQ ID NO: 235 with a Pfam accession PF00113 and to (ii) a Conserved Enolase C Domain as represented by SEQ ID NO: 236 with a Pfam accession PF03952 and optionally having Enolase (2-phospho-D-glycerate hydro-lyase) activity.

Additionally, an "Enolase polypeptide" as defined herein preferably comprises one or more of the following protein motifs (i) SIE(D/Q)PFD (SEQ ID NO: 237); (ii) VGDDLL (SEQ ID NO: 238); (iii) GAPCR (SEQ ID NO: 239); and KYNQ(L/I)LRIE (SEQ ID NO: 240); wherein any amino acid may be substituted by a conservative amino acid according to Table 1.

Further preferably an "Enolase polypeptide" useful in the methods of the invention comprises one or more protein signatures having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to:
  (i) amino acids residues 38-52 of SEQ ID NO: 194;
  (ii) amino acids residues 113-129 of SEQ ID NO: 194;
  (iii) amino acids residues 170-183 of SEQ ID NO: 194;
  (iv) amino acids residues 328-339 of SEQ ID NO: 194;
  (v) amino acids residues 351-365 of SEQ ID NO: 194; and
  (vi) amino acids residues 380-397 of SEQ ID NO: 194;
wherein any amino acid residue may be substituted by a conservative amino acid according to Table 1.

The protein signatures mentioned above from (i) to (Vi) correspond to the 6-element fingerprint which typically provides a signature for Enolases. The elements abovementioned has accession number PR00148 in PRINTS-S database (PRINTS-S Version 16 modelled on PRINTS Version 38.0, Attwood et al. 2003 Nucleic Acids Research, 31(1), 400-402). Such signatures may be identified using tools and methods well known in the art such as SPRINT, a Web tool developed and maintain by Attwood and colleagues at the Faculty of Life Sciences in The University of Manchester, Manchester M13 9PT, UK. Alternatively, the signatures may be identified searching in databases containin conserved protein sequences or domains, or motifs or signatures, protein alignments, for example using Interpro. Further details are provided in the Examples section.

In one embodiment of the invention the Enolase polypeptide comprises one or more protein domains having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to:
  (i) SEQ ID NO: 245 which corresponds to the conserved DNA binding domain;
  (ii) SEQ ID NO: 246 which corresponds to the conserved repressor domain.

Typically an Enolase polypeptide has Enolase activity (2-phospho-D-glycerate hydro-lyase) corresponding to IntEnz (Integrated relational Enzyme database, Fleischmann et al. 2004 Nucleic Acids Res. 32, D434-D437) classification number of EC: 4.2.1.11. The enzyme Enolase catalyzes the reaction 2-phospho-D-glycerate=phosphoenolpyruvate+$H_2O$.

Other accepted terms in the art for referring to an Enolase enzyme are phosphopyruvate hydratase and 14-3-2-protein, 2-phosphoglycerate dehydratase, 2-phosphoglycerate Enolase, 2-phosphoglyceric dehydratase and γ-Enolase, phosphoenolpyruvate hydratase and 2-phospho-D-glycerate hydro-lyase.

Alternatively, an Enolase protein and a homologue thereof has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 194, provided that the homologous protein comprises the conserved Enolase N and Enolase C domains as outlined above. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Preferably, the polypeptide sequence which when used in the construction of a phylogenetic tree, such as the one depicted in FIG. 4, clusters with any of the Enolase polypeptides in the tree rather than falling outside of the clades and therefore constituting an outgroup.

A "ZAT-like zinc transporter polypeptide" as defined herein refers to any polypeptide comprising in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 249. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Preferably, the polypeptide sequence which when used in the construction of a phylogenetic tree, such as the one depicted in FIG. 7, clusters with the group of ZAT-like zinc transporter polypeptides comprising the amino acid sequence represented by SEQ ID NO: 248 249 rather than with any other group.

A "6-PGDH polypeptide" as defined herein refers to a 6-phosphogluconate dehydrogenase (6-PGDH). 6-PGDH protein belong to the Enzyme class: EC1.1.1.44. Its chemical composition and biochemical properties are well known in the art (Sundaramoorthy et al. 2007 FEBS J. 2007 January; 274(1):275-86; Huang et al. 2003 Mol Biol Rep 30(4):223-7; Krepeinsky et al. 2001 Eur J. Biochem. May; 268(9):2678-86.

Alternatively, a "6-PGDH polypeptide" as defined herein refers the proteins represented by SEQ ID NO: 282, and to orthologues, paralogues, and homologues thereof. Preferred homologues, including orthologues and paralogues useful in the methods of the invention are described in Table A4.

Preferably, a 6-PGDH protein of the invention, in particular the orthologues, paralogues, and homologues of SEQ ID NO: 282 have a 6-phosphogluconate dehydrogenase domain with Interpro accession number IPR006115 or Pfam accession number PF03446. More preferably the 6-PGDH polypeptide useful in the methods of the invention comprise a protein domain having 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid represented by the SEQ ID NO: 283 which represents the 6-phosphogluconate dehydrogenase domain comprise in SEQ ID NO: 282 between amino acid position 3 to 178.

Furthermore preferably, a 6-PGDH protein of the invention, in particular the orthologues, paralogues, and homologues of SEQ ID NO: 282 have a conserved 6-phosphogluconate dehydrogenase C-terminal domain with Interpro accession number IPR006114 or Pfam accession number PF0393 (see. Examples section). More preferably the 6-PGDH polypeptide useful in the methods of the invention comprise a protein domain having 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid located between amino acid position 182 and 472 of SEQ ID NO: 282, which corresponds to the C-terminal domain of the 6-phosphogluconate dehydrogenase of SEQ ID NO: 282.

A further preferred 6-PGDH polypeptide useful in the methods of the invention has an aspartic amino acid residue at a position equivalent to D255 of SEQ ID NO: 282 or at position D253 in the L. lactis 6-PGDH enzyme (Sundaramoorthy et al; 2007). FIG. 9 shows an alignment of 6-PGDH polypeptide where the equivalent amino acids to D255 in several 6-PGDH polypeptide are shown.

Methods to identify the equivalent amino acids between 6-PGDH polypeptides at a given position are well known in the art. For example the polypeptide may be compared to the motif by aligning their respective amino acid sequence to identify regions with similar sequence using a suitable alignment algorithm such as BLAS (Altschul et al. J Mol Biol 215: 403-10).

Alternatively or additionally, a "6-PGDH polypeptide" as defined herein refers to any polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% amino acid sequence identity to the 6-PGDH polypeptide as represented by SEQ ID NO: 282 or any one of the polypeptides of Table A4.

The terms "domain", "signature" and "motif" are defined in the "definitions" section herein. Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Concerning MSR polypeptides, alternatively, a conserved motif may also be identified simply by eye inspection of a multiple sequence alignment, for example of the polypeptide sequence of Table A1, and as shown in FIG. 3.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol. 147(1); 195-7).

Furthermore, MSR polypeptides (at least in their native form) typically have methione sulfoxide reductase activity. Tools and techniques for measuring MSR activity are well known in the art. For example MSR activity may be assayed in vitro with either a protein substrate (oxidized α-1 protease inhibitor) or a synthetic substrate (N-acetyl-[3H]-MetSO) as described by Sadanadom et al. Plant Physiol. 2000; 123(1): 255-264 or Boschi-Muller et al; 2008 and references therein or Vieira-Dos Santos et al Plant Physiol. 2005, 138(2):909-22.

In addition, MSR polypeptides, when expressed in rice according to the methods of the present invention as outlined in the example section, give plants having increased yield-related traits selected from: early vigour, total seed weight, number of filled seeds and harvest index.

Furthermore, ENOLASE polypeptides (at least in their native form) typically have 2-phospho-D-glycerate hydrolyase activity (Enolase activity). Tools and techniques for measuring Enolase activity are well known in the art. Activity of an Enolase polypeptide may be determined in an in vivo assay by complementation of the E. coli strain defective in Enolase function as described by Lal et al. 1991. Plant Mol. Biol. 16(5):787-95. Alternatively, Enolase activity may be determined in an in vitro assay as for examples described by Eigembrod et al; 1983 EMBO J. 1983; 2(9): 1565-1570 and/or Geige 2003; The Plant Cell, Vol. 15, 2140-2151. Alternatively, the activity of an enolase nucleic acid and the protein encoded thereof may be determined by assaying the DNA binding ability of the protein to the c-myc promoter or to the promoter of the zinc finger STZ/ZAT10 from *Arabidopsis* in cells transformed with a vector comprising the enolase nucleic acid as described by Lee et al. 2002.

In addition, ENOLASE polypeptides, when expressed in rice according to the methods of the present invention as outlined in the Example section, give plants having increased yield related traits, in particular one or more traits selected from: harvest index, seed filling rate, total seed yield, and number of filled seeds.

Furthermore, ZAT-like zinc transporter polypeptides (at least in their native form) typically have zinc transporter activity. Furthermore, the introduction into a plant of any nucleic acid encoding a ZAT-like zinc transporter polypeptide leads to the generation of plants having increased yield, especially seed yield.

Furthermore, 6-PGDH polypeptides (at least in their native form), as far as SEQ ID NO: 282 and its homologues are concerned; preferably have 6-Phosphogluconate dehydrogenase (EC 1.1.1.44). Tools and techniques for measuring DNA binding activity are well known in the art.

Concerning MSR polypeptides, the present invention is illustrated by transforming plants with the nucleic acid sequence represented by SEQ ID NO: 1 and by SEQ ID NO: 101 encoding the polypeptide sequence of SEQ ID NO: 2 and SEQ ID NO: 102 respectively. However, performance of the invention is not restricted to these sequences; the methods of the invention may advantageously be performed using any MSR-encoding nucleic acid or MSR polypeptide as defined herein.

Examples of nucleic acids encoding MSR polypeptides are given in Table A1 of The Examples section herein. Such nucleic acids are useful in performing the methods of the invention. The amino acid sequences given in Table A1 of The Examples section are example sequences of orthologues and paralogues of the MSR polypeptide represented by SEQ ID NO: 2 or SEQ ID NO: 102, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A1 of The Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 1 or SEQ ID NO: 2, the second BLAST would therefore be against rice sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning enolase polypeptides, the present invention is illustrated by transforming plants with the nucleic acid sequence represented by SEQ ID NO: 193, encoding the polypeptide sequence of SEQ ID NO: 194. However, performance of the invention is not restricted to these sequences; the methods of the invention may advantageously be performed using any ENOLASE-encoding nucleic acid or ENOLASE polypeptide as defined herein.

Examples of nucleic acids encoding ENOLASE polypeptides are given in Table A2 of The Examples section herein. Such nucleic acids are useful in performing the methods of the invention. The amino acid sequences given in Table A2 of The Examples section are example sequences of orthologues and paralogues of the ENOLASE polypeptide represented by SEQ ID NO: 194, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A2 of The Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 193 or SEQ ID NO: 194, the second BLAST would therefore be against rice sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning ZAT-like zinc transporter polypeptides, the present invention is illustrated by transforming plants with the nucleic acid sequence represented by SEQ ID NO: 247, encoding the polypeptide sequence of SEQ ID NO: 249. However, performance of the invention is not restricted to these sequences; the methods of the invention may advantageously be performed using any nucleic acid encoding a ZAT-like zinc transporter polypeptide as defined herein.

Examples of nucleic acids encoding ZAT-like zinc transporter polypeptides are given in Table A3 of Example 1 herein. Such nucleic acids are useful in performing the methods of the invention. The amino acid sequences given in Table A3 of Example 1 are example sequences of orthologues and paralogues of the ZAT-like zinc transporter polypeptide represented by SEQ ID NO: 248, the terms "orthologues" and "paralogues" being as defined herein. Further orthologues and paralogues may readily be identified by performing a so-called reciprocal blast search. Typically, this involves a first BLAST involving BLASTing a query sequence (for example using any of the sequences listed in Table A3 of Example 1) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 247 or SEQ ID NO: 249, the second BLAST would therefore be against *Arabidopsis thaliana* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

Concerning 6-PGDH polypeptides, the present invention is illustrated by transforming plants with the nucleic acid sequence represented by SEQ ID NO: 281, encoding the polypeptide sequence of SEQ ID NO: 282. However, performance of the invention is not restricted to these sequences; the methods of the invention may advantageously be performed using any 6-PGDH-encoding nucleic acid or 6-PGDH polypeptide as defined herein, preferably any one of those listed in Table A4.

Examples of nucleic acids encoding 6-PGDH polypeptides may be found in databases known in the art. Such nucleic acids are useful in performing the methods of the invention. Orthologues and paralogues, the terms "orthologues" and "paralogues" being as defined herein, may readily be identified by performing a so-called reciprocal blast search. Typically, this involves a first BLAST involving BLASTing a query sequence (for example using SEQ ID NO: 282) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived (where the query sequence is SEQ ID NO: 281 or SEQ ID NO: 282, the second BLAST would therefore be against *Oryza sativa* sequences). The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Nucleic acid variants may also be useful in practising the methods of the invention. Examples of such variants include nucleic acids encoding homologues and derivatives of any one of the amino acid sequences given in Table A1 to A4 of The Examples section, the terms "homologue" and "derivative" being as defined herein. Also useful in the methods of the invention are nucleic acids encoding homologues and derivatives of orthologues or paralogues of any one of the amino acid sequences given in Table A1 to A4 of The Examples section. Homologues and derivatives useful in the methods of the present invention have substantially the same biological and functional activity as the unmodified protein from which they are derived.

Further nucleic acid variants useful in practising the methods of the invention include portions of nucleic acids encoding MSR polypeptides, or enolase polypeptides, or ZAT-like zinc transporter polypeptides, or 6-PGDH polypeptides, or nucleic acids hybridising to nucleic acids encoding MSR polypeptides, or enolase polypeptides, or ZAT-like zinc transporter polypeptides, or 6-PGDH polypeptides, splice variants of nucleic acids encoding MSR polypeptides, or enolase polypeptides, or ZAT-like zinc transporter polypeptides, or 6-PGDH polypeptides, allelic variants of nucleic acids encoding MSR polypeptides and variants of nucleic acids encoding MSR polypeptides, or enolase polypeptides, or ZAT-like zinc transporter polypeptides, or 6-PGDH polypeptides, obtained by gene shuffling. The terms hybridising sequence, splice variant, allelic variant and gene shuffling are as described herein.

Concerning MSR polypeptides, for example SEQ ID NO: 1 represents a variant of SEQ ID NO: 57 having a truncation at the 5' end. Therefore SEQ ID NO: 1 encodes a derivative of the polypeptide represented by SEQ ID NO: 57, having a truncation a the N-terminus and represented by SEQ ID NO: 2. Similarly SEQ ID NO: 101 encode a variant of SEQ ID NO: 133 having a truncation at the 5' end. Therefore SEQ ID NO: 101 encodes SEQ ID NO: 102 which is a derivative of the polypeptide represented by SEQ ID NO: 134.

Nucleic acids encoding MSR polypeptides, or enolase polypeptides, or ZAT-like zinc transporter polypeptides, or 6-PGDH polypeptides, need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A1 to A4 of The Examples section, or a portion of a nucleic acid encoding an orthologue, paralogue or homologue of any of the amino acid sequences given in Table A1 to A4 of The Examples section.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Concerning MSR polypeptides, portions useful in the methods of the invention, encode an MSR polypeptide as defined herein, and have substantially the same biological activity as the amino acid sequences given in Table A1 of The Examples section. Preferably, the portion is a portion of any one of the nucleic acids given in Table A1 of The Examples section, or is a portion of a nucleic acid encoding an orthologue or paralogue of any one of the amino acid sequences given in Table A1 of The Examples section. Preferably the portion is at least 300, 400, 500, 550, 600, 650, 700, 750, 800, 850, 900, 950, 1000 consecutive nucleotides in length, the consecutive nucleotides being of any one of the nucleic acid sequences given in Table A1 of The Examples section, or of a nucleic acid encoding an orthologue or paralogue of any one of the amino acid sequences given in Table A1 of The Examples section. Most preferably the portion is a portion of the nucleic acid of SEQ ID NO: 1. Preferably, the portion encodes a fragment of an amino acid sequence having in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more amino acid sequence identity to any of the polypeptide sequences given in Table A1 herein provided that the portion comprises one or more of provided conserved motifs as outlined above.

Concerning enolase polypeptides, portions useful in the methods of the invention, encode an Enolase polypeptide as defined herein, and have substantially the same biological activity as the amino acid sequences given in Table A2 of The Examples section. Preferably, the portion is a portion of any one of the nucleic acids given in Table A2 of The Examples section, or is a portion of a nucleic acid encoding an orthologue or paralogue of any one of the amino acid sequences given in Table A2 of The Examples section. Preferably the portion is at least 100, 200, 300, 400, 500, 550, 600, 650, 700, 750, 800, 850, 900, 950, 1000 consecutive nucleotides in length, the consecutive nucleotides being of any one of the nucleic acid sequences given in Table A2 of The Examples section, or of a nucleic acid encoding an orthologue or paralogue of any one of the amino acid sequences given in Table A2 of The Examples section. Most preferably the portion is a portion of the nucleic acid of SEQ ID NO: 193. Preferably, the portion encodes a fragment of an amino acid sequence which, when used in the construction of a phylogenetic tree, such as the one depicted in FIG. 4, clusters with any of the Enolase polypeptides in the tree rather than falling outside of the clades and therefore constituting an outgroup.

Concerning ZAT-like zinc transporter polypeptides, portions useful in the methods of the invention, encode a ZAT-like zinc transporter polypeptide as defined herein, and have substantially the same biological activity as the amino acid sequences given in Table A3 of Example 1. Preferably, the portion is a portion of any one of the nucleic acids given in Table A3 of Example 1, or is a portion of a nucleic acid encoding an orthologue or paralogue of any one of the amino acid sequences given in Table A3 of Example 1. Preferably the portion is at least 500, 550, 600, 650, 700, 750, 800, 850, 900, 950, 1000, 1050, 1100, 1150, 1200 or more consecutive nucleotides in length, the consecutive nucleotides being of any one of the nucleic acid sequences given in Table A3 of Example 1, or of a nucleic acid encoding an orthologue or paralogue of any one of the amino acid sequences given in Table A3 of Example 1. Most preferably the portion is a portion of the nucleic acid of SEQ ID NO: 247. Preferably, the portion encodes a fragment of an amino acid sequence which, when used in the construction of a phylogenetic tree, such as the one depicted in FIG. 7, clusters with the group of ZAT-like zinc transporter polypeptides comprising the amino acid sequence represented by SEQ ID NO: 249 rather than with any other group.

Concerning 6-PGDH polypeptides, portions useful in the methods of the invention, encode a 6-PGDH polypeptide as defined herein, and have substantially the same biological activity as the amino acid sequences given in SEQ ID NO: 282. Preferably, the portion is a portion of any one of the nucleic acids given in SEQ ID NO: 281, or is a portion of a nucleic acid encoding an orthologue or paralogue of any one of the amino acid sequences given in SEQ ID NO: 281. Preferably the portion is at least 100, 200, 300, 400, 500, 550, 600, 650, 700, 750, 800, 850, 900 consecutive nucleotides in length, the consecutive nucleotides being of SEQ ID NO: 281, or of a nucleic acid encoding an orthologue or paralogue of SEQ ID NO: 282. Most preferably the portion is a portion of the nucleic acid of SEQ ID NO: 281.

Concerning MSR polypeptides, alternatively the portion encodes a fragment of an MSR polypeptide which when used in the construction of a phylogenetic tree, such as the one depicted in FIG. 2 of Rouhier et al. 2006, clusters with the group of AtMSRB1 or OsMSRA4 polypeptides rather than with any other group.

Another nucleic acid variant useful in the methods of the invention is a nucleic acid capable of hybridising, under reduced stringency conditions, preferably under stringent conditions, with a nucleic acid encoding an MSR polypeptide, or an enolase polypeptide, or a ZAT-like zinc transporter polypeptide, or a 6-PGDH polypeptide, as defined herein, or with a portion as defined herein.

According to the present invention, there is provided a method for enhancing yield-related traits in plants, comprising introducing and expressing in a plant a nucleic acid capable of hybridizing to any one of the nucleic acids given in Table A1 to A4 of The Examples section, or comprising introducing and expressing in a plant a nucleic acid capable of hybridising to a nucleic acid encoding an orthologue, paralogue or homologue of any of the nucleic acid sequences given in Table A1 to A4 of The Examples section.

Concerning MSR polypeptides, hybridising sequences useful in the methods of the invention encode an MSR polypeptide as defined herein, having substantially the same biological activity as the amino acid sequences given in Table A1 of The Examples section. Preferably, the hybridising sequence is capable of hybridising to the complement of any one of the nucleic acids given in Table A1 of The Examples section, or to a portion of any of these sequences, a portion being as defined above, or the hybridising sequence is capable of hybridising to the complement of a nucleic acid encoding an orthologue or paralogue of any one of the amino acid sequences given in Table A1 of The Examples section. Most preferably, the hybridising sequence is capable of hybridising to the complement of a nucleic acid as represented by SEQ ID NO: 1 or to a portion thereof.

Preferably, the hybridising sequence encodes a polypeptide with an amino acid sequence having in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to any of the polypeptide sequences given in Table A1 herein provided that the polypeptide comprises one or more of provided conserved motifs as outlined above.

Alternatively, the hybridising sequence encodes a polypeptide with an amino acid sequence which when used in the construction of a phylogenetic tree, such as the one depicted in FIG. 2 of Rouhier et al. 2006, clusters with the group of AtMSRB1 or OsMSRA4 polypeptides rather than with any other group.

Concerning enolase polypeptides, hybridising sequences useful in the methods of the invention encode an Enolase polypeptide as defined herein, having substantially the same biological activity as the amino acid sequences given in Table A2 of The Examples section. Preferably, the hybridising sequence is capable of hybridising to the complement of any one of the nucleic acids given in Table A2 of The Examples section, or to a portion of any of these sequences, a portion being as defined above, or the hybridising sequence is capable of hybridising to the complement of a nucleic acid encoding an orthologue or paralogue of any one of the amino acid sequences given in Table A2 of The Examples section. Most preferably, the hybridising sequence is capable of hybridising to the complement of a nucleic acid as represented by SEQ ID NO: 193 or to a portion thereof.

Preferably, the hybridising sequence encodes a polypeptide with an amino acid sequence which, when full-length and used in the construction of a phylogenetic tree, such as the one depicted in FIG. 4, clusters with any of the Enolase polypeptides in the tree rather than falling outside of the clades and therefore constituting an outgroup.

Concerning ZAT-like zinc transporter polypeptides, hybridising sequences useful in the methods of the invention encode a ZAT-like zinc transporter polypeptide as defined herein, having substantially the same biological activity as the amino acid sequences given in Table A3 of Example 1. Preferably, the hybridising sequence is capable of hybridising to the complement of any one of the nucleic acids given in Table A3 of Example 1, or to a portion of any of these sequences, a portion being as defined above, or the hybridising sequence is capable of hybridising to the complement of a nucleic acid encoding an orthologue or paralogue of any one of the amino acid sequences given in Table A3 of Example 1. Most preferably, the hybridising sequence is capable of hybridising to the complement of a nucleic acid as represented by SEQ ID NO: 247 or to a portion thereof.

Preferably, the hybridising sequence encodes a polypeptide with an amino acid sequence which, when full-length and used in the construction of a phylogenetic tree, such as the one depicted in FIG. 7, clusters with the group of ZAT-like zinc transporter polypeptides comprising the amino acid sequence represented by SEQ ID NO: 249 rather than with any other group.

Concerning 6-PGDH polypeptides, hybridising sequences useful in the methods of the invention encode a 6-PGDH polypeptide as defined herein, having substantially the same biological activity as the amino acid sequences given in SEQ ID NO: 282. Preferably, the hybridising sequence is capable of hybridising to SEQ ID NO: 281, or to a portion of any of these sequences, a portion being as defined above, or the hybridising sequence is capable of hybridising to a nucleic acid encoding an orthologue or paralogue of SEQ ID NO: 282.

Another nucleic acid variant useful in the methods of the invention is a splice variant encoding an MSR polypeptide, or an enolase polypeptide, or a ZAT-like zinc transporter polypeptide, or a 6-PGDH polypeptide, as defined hereinabove, a splice variant being as defined herein.

According to the present invention, there is provided a method for enhancing yield-related traits in plants, comprising introducing and expressing in a plant a splice variant of any one of the nucleic acid sequences given in Table A1 to A4 of The Examples section, or a splice variant of a nucleic acid encoding an orthologue, paralogue or homologue of any of the amino acid sequences given in Table A1 to A4 of The Examples section.

Concerning MSR polypeptides, preferred spliced variants are splice variants of a nucleic acid represented by SEQ ID NO: 1 or SEQ ID NO: 101, or a splice variant of a nucleic acid encoding an orthologue or paralogue of SEQ ID NO: 2 or SEQ ID NO: 102 respectively. Preferably, the amino acid sequence encoded by the splice variant has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more amino acid sequence identity to any of the polypeptide sequences given in Table A1 herein provided that the encoded orthologue or paralogue comprise one or more of provided conserved motifs as outlined above.

Alternatively, spliced variants are splice variants of a nucleic acid encoding an amino acid sequence which when used in the construction of a phylogenetic tree, such as the one depicted in FIG. 2 of Rouhier et al. 2006, clusters with the group of AtMSRB1 or OsMSRA4 polypeptides rather than with any other group.

Concerning enolase polypeptides, preferred splice variants are splice variants of a nucleic acid represented by SEQ ID NO: 193, or a splice variant of a nucleic acid encoding an orthologue or paralogue of SEQ ID NO: 194. Preferably, the amino acid sequence encoded by the splice variant, when used in the construction of a phylogenetic tree, such as the one depicted in FIG. 4, clusters with any of the Enolase polypeptides in the tree rather than falling outside of the clades and therefore constituting an outgroup.

Concerning ZAT-like zinc transporter polypeptides, preferred splice variants are splice variants of a nucleic acid represented by SEQ ID NO: 247, or a splice variant of a nucleic acid encoding an orthologue or paralogue of SEQ ID NO: 249. Preferably, the amino acid sequence encoded by the splice variant, when used in the construction of a phylogenetic tree, such as the one depicted in FIG. 7, clusters with the group of ZAT-like zinc transporter polypeptides comprising the amino acid sequence represented by SEQ ID NO: 249 rather than with any other group.

Another nucleic acid variant useful in performing the methods of the invention is an allelic variant of a nucleic acid encoding an MSR polypeptide, or an enolase polypeptide, or a ZAT-like zinc transporter polypeptide, or a 6-PGDH polypeptide, as defined hereinabove, an allelic variant being as defined herein.

Concerning MSR polypeptides, the allelic variant preferably is a nucleic acid encoding an amino acid sequence which when used in the construction of a phylogenetic tree, such as the one depicted in FIG. 2 of Rouhier et al. 2006, clusters with the group of AtMSRB1 or OsMSRA4 polypeptides rather than with any other group.

According to the present invention, there is provided a method for enhancing yield-related traits in plants, comprising introducing and expressing in a plant an allelic variant of any one of the nucleic acids given in Table A1 to A4 of The Examples section, or comprising introducing and expressing in a plant an allelic variant of a nucleic acid encoding an orthologue, paralogue or homologue of any of the amino acid sequences given in Table A1 to A4 of The Examples section.

Concerning MSR polypeptides, the polypeptides encoded by allelic variants useful in the methods of the present invention have substantially the same biological activity as the MSR polypeptide of SEQ ID NO: 2 or SEQ ID NO: 102 and any of the amino acids depicted in Table A1 of The Examples section. Allelic variants exist in nature, and encompassed within the methods of the present invention is the use of these natural alleles. Preferably, the allelic variant is an allelic variant of SEQ ID NO: 1 or SEQ ID NO: 101 or an allelic variant of a nucleic acid encoding an orthologue or paralogue of SEQ ID NO: 2 or SEQ ID NO: 102. Preferably, the amino acid sequence encoded by the allelic variant having in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more amino acid sequence identity to any of the polypeptide sequences given in Table A1 herein provided that the encoded orthologue or paralogue comprise one or more of provided conserved motifs as outlined above.

Concerning enolase polypeptides, the polypeptides encoded by allelic variants useful in the methods of the present invention have substantially the same biological activity as the ENOLASE polypeptide of SEQ ID NO: 194 and any of the amino acids depicted in Table A2 of The Examples section. Allelic variants exist in nature, and encompassed within the methods of the present invention is the use of these natural alleles. Preferably, the allelic variant is an allelic variant of SEQ ID NO: 193 or an allelic variant of a nucleic acid encoding an orthologue or paralogue of SEQ ID NO: 194. Preferably, the amino acid sequence encoded by the allelic variant, when used in the construction of a phylogenetic tree, such as the one depicted in FIG. 4, clusters with any of the Enolase polypeptides in the tree rather than falling outside of the clades and therefore constituting an outgroup.

Concerning ZAT-like zinc transporter polypeptides, the polypeptides encoded by allelic variants useful in the methods of the present invention have substantially the same biological activity as the ZAT-like zinc transporter polypeptide of SEQ ID NO: 249 and any of the amino acids depicted in Table A3 of Example 1. Allelic variants exist in nature, and encompassed within the methods of the present invention is the use of these natural alleles. Preferably, the allelic variant is an allelic variant of SEQ ID NO: 247 or an allelic variant of a nucleic acid encoding an orthologue or paralogue of SEQ ID NO: 249. Preferably, the amino acid sequence encoded by the allelic variant, when used in the construction of a phylogenetic tree, such as the one depicted in FIG. 7, clusters with the ZAT-like zinc transporter polypeptides comprising the amino acid sequence represented by SEQ ID NO: 249 rather than with any other group.

Concerning 6-PGDH polypeptides, the allelic variants useful in the methods of the present invention have substantially the same biological activity as the 6-PGDH polypeptide of SEQ ID NO: 282. Allelic variants exist in nature, and encompassed within the methods of the present invention is the use of these natural alleles.

Gene shuffling or directed evolution may also be used to generate variants of nucleic acids encoding MSR polypeptides, or enolase polypeptides, or ZAT-like zinc transporter polypeptides, or 6-PGDH polypeptides, as defined above; the term "gene shuffling" being as defined herein.

According to the present invention, there is provided a method for enhancing yield-related traits in plants, comprising introducing and expressing in a plant a variant of any one of the nucleic acid sequences given in Table A1 to A4 of The Examples section, or comprising introducing and expressing in a plant a variant of a nucleic acid encoding an orthologue, paralogue or homologue of any of the amino acid sequences given in Table A1 to A4 of The Examples section, which variant nucleic acid is obtained by gene shuffling.

Concerning MSR polypeptides, preferably, the amino acid sequence encoded by the variant nucleic acid obtained by gene shuffling, has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more amino acid sequence identity to any of the polypeptide sequences given in Table A1 herein provided that the encoded amino acid comprise one or more of provided conserved motifs as outlined above.

Concerning enolase polypeptides, preferably, the amino acid sequence encoded by the variant nucleic acid obtained by gene shuffling, when used in the construction of a phylogenetic tree such as the one depicted in FIG. 4, clusters with any of the Enolase polypeptides in the tree rather than falling outside of the clades and therefore constituting an outgroup.

Concerning ZAT-like zinc transporter polypeptides, preferably, the amino acid sequence encoded by the variant nucleic acid obtained by gene shuffling, when used in the construction of a phylogenetic tree such as the one depicted in FIG. 7, clusters with the group of ZAT-like zinc transporter polypeptides comprising the amino acid sequence represented by SEQ ID NO: 249 rather than with any other group.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding MSR polypeptides may be derived from any natural or artificial source. The nucleic acid may be modified from its native form in composition and/or genomic environment through deliberate human manipulation. Preferably the MSR polypeptide-encoding nucleic acid is from a plant, further preferably from a monocotyledonous plant, more preferably from the family Poaceae, most preferably the nucleic acid is from *Oryza sativa*. Alternatively, a preferred MSR polypeptide-encoding nucleic acid is from a dycotiledoneous plants, more preferably from the plant *Medicago truncatula*.

Advantageously, the invention also provides hitherto unknown MSR-encoding nucleic acids and MSR polypeptides.

According to a further embodiment of the present invention, there is therefore provided an isolated nucleic acid molecule selected from:

(i) a nucleic acid represented by any one of SEQ ID NO: 31, 33, 41, 105, 107, 109, 113, 115, 117, 119, 121, 123, 125, 165, 167, 169 and SEQ ID NO: 171;

(ii) the complement of a nucleic acid represented by any one of SEQ ID NO: 31, 33, 41, 105, 107, 109, 113, 115, 117, 119, 121, 123, 125, 165, 167, 169, and SEQ ID NO: 171;

(iii) a nucleic acid encoding the polypeptide as represented by any one of SEQ ID NO: 32, 34, 42, 106, 108, 110, 114, 116, 118, 120, 122, 124, 126, 166, 168, 170, and SEQ ID NO: 172, preferably as a result of the degeneracy of the genetic code, said isolated nucleic acid can be derived from a polypeptide sequence as represented by any one of SEQ ID NO: 32, 34, 42, 106, 108, 110, 114, 116, 118, 120, 122, 124, 126, 166, 168, 170, and SEQ ID NO: 172 and further preferably confers enhanced yield-related traits relative to control plants;

(iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A1 and further preferably conferring enhanced yield-related traits relative to control plants;

(v) a nucleic acid molecule which hybridizes with a nucleic acid molecule of (i) to (iv) under stringent hybridization conditions and preferably confers enhanced yield-related traits relative to control plants;

(vi) a nucleic acid encoding an MSR polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 32, 34, 42, 106, 108, 110, 114, 116, 118, 120, 122, 124, 126, 166, 168, 170, and SEQ ID NO: 172, and any of the other amino acid sequences in Table A1 and preferably conferring enhanced yield-related traits relative to control plants.

According to a further embodiment of the present invention, there is also provided an isolated polypeptide selected from:

(i) an amino acid sequence represented by any one of SEQ ID NO: 32, 34, 42, 106, 108, 110, 114, 116, 118, 120, 122, 124, 126, 166, 168, 170, and SEQ ID NO: 172;

(ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 32, 34, 42, 106, 108, 110, 114, 116, 118, 120, 122, 124, 126, 166, 168, 170, and SEQ ID NO: 172 or any of the other amino acid sequences in Table A1 and preferably conferring enhanced yield-related traits relative to control plants.

(iii) derivatives of any of the amino acid sequences given in (i) or (ii) above.

Nucleic acids encoding ENOLASE polypeptides may be derived from any natural or artificial source. The nucleic acid may be modified from its native form in composition and/or genomic environment through deliberate human manipulation. Preferably the ENOLASE polypeptide-encoding nucleic acid is from a plant, further preferably from a monocotyledonous plant, more preferably from the family Poaceae, most preferably the nucleic acid is from *Oryza sativa*.

Nucleic acids encoding ZAT-like zinc transporter polypeptides may be derived from any natural or artificial source. The nucleic acid may be modified from its native form in composition and/or genomic environment through deliberate human manipulation. Preferably the nucleic acid encoding a ZAT-like zinc transporter polypeptide is from a plant, further preferably from a dicotyledonous plant, more preferably from the family Brasicaceae, most preferably the nucleic acid is from *Arabidopsis thaliana*.

Nucleic acids encoding 6-PGDH polypeptides may be derived from any natural or artificial source. The nucleic acid may be modified from its native form in composition and/or genomic environment through deliberate human manipulation. Preferably the 6-PGDH polypeptide-encoding nucleic acid is from a plant. In the case of SEQ ID NO: 281, the 6-PGDH polypeptide encoding nucleic acid is preferably from a monocotyledonous plant, more preferably from the family Poaceae, most preferably the nucleic acid is from *Oryza sativa*.

Concerning MSR polypeptides, or enolase polypeptides, or ZAT-like zinc transporter polypeptides, performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Concerning 6-PGDH polypeptides, performance of the methods of the invention gives plants having enhanced yield-related traits. In particular performance of the methods of the invention gives plants having increased early vigour and increased yield, especially increased biomass and increased seed yield relative to control plants. The terms "yield" and "seed yield" are described in more detail in the "definitions" section herein.

Concerning MSR polypeptides, or enolase polypeptides, or ZAT-like zinc transporter polypeptides, reference herein to enhanced yield-related traits is taken to mean an increase in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

Concerning 6-PGDH polypeptides, reference herein to enhanced yield-related traits is taken to mean an increase in early vigour and/or in biomass (weight) of one or more parts of a plant, which may include aboveground (harvestable) parts and/or (harvestable) parts below ground. In particular, such harvestable parts are biomass and/or seeds, and performance of the methods of the invention results in plants having increased early vigour, biomass and/or seed yield relative to the early vigour, biomass or seed yield of control plants.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, number of spikelets per panicle, number of flowers (florets) per panicle (which is expressed as a ratio of the number of filled seeds over the number of primary panicles), increase in the seed filling rate (which is the number of filled seeds divided by the total number of seeds and multiplied by 100), increase in thousand kernel weight, among others.

The present invention provides a method for increasing yield, especially seed yield of plants, relative to control plants, which method comprises modulating expression in a plant of a nucleic acid encoding an MSR polypeptide, or an enolase polypeptide, or a ZAT-like zinc transporter polypeptide, as defined herein.

The present invention also provides a method for increasing yield, especially biomass and/or seed yield of plants, relative to control plants, which method comprises modulating expression, preferably increasing expression, in a plant of a nucleic acid encoding a 6-PGDH polypeptide as defined herein.

Since the transgenic plants according to the present invention have increased yield, it is likely that these plants exhibit an increased growth rate (during at least part of their life cycle), relative to the growth rate of control plants at a corresponding stage in their life cycle.

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

According to a preferred feature of the present invention, performance of the methods of the invention gives plants having an increased growth rate relative to control plants. Therefore, according to the present invention, there is provided a method for increasing the growth rate of plants, which method comprises modulating expression in a plant of a nucleic acid encoding an MSR polypeptide, or an enolase polypeptide, or a ZAT-like zinc transporter polypeptide, or a 6-PGDH polypeptide, as defined herein. Concerning 6-PGDH polypeptides, in a particular embodiment, performance of the methods of the present invention gives plants with increased early vigour.

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35% or 30%, preferably less than 25%, 20% or 15%, more preferably less than 14%, 13%, 12%, 11% or 10% or less in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% A of the average production of such plant in a given environment. Average production may be calculated on harvest and/or season basis. Persons skilled in the art are aware of average yield productions of a crop.

Performance of the methods of the invention gives plants grown under non-stress conditions or under mild drought conditions increased yield and/or increased early vigour relative to control plants grown under comparable conditions.

Therefore, according to the present invention, there is provided a method for increasing yield and/or early vigour in plants grown under non-stress conditions or under mild drought conditions, which method comprises modulating expression in a plant of a nucleic acid encoding an MSR polypeptide, or an enolase polypeptide, or a ZAT-like zinc transporter polypeptide, or a 6-PGDH polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding an MSR polypeptide, or an enolase polypeptide, or a ZAT-like zinc transporter polypeptide, or a 6-PGDH polypeptide. Nutrient deficiency may result from a lack of nutrients such as nitrogen, phosphates and other phosphorous-containing compounds, potassium, calcium, cadmium, magnesium, manganese, iron and boron, amongst others.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding an MSR polypeptide. The term salt stress is not restricted to common salt (NaCl), but may be any one or more of: NaCl, KCl, LiCl, $MgCl_2$, $CaCl_2$, amongst others.

The present invention encompasses plants or parts thereof (including seeds) obtainable by the methods according to the present invention. The plants or parts thereof comprise a nucleic acid transgene encoding an MSR polypeptide, or an enolase polypeptide, or a ZAT-like zinc transporter polypeptide, or a 6-PGDH polypeptide, as defined above.

The invention also provides genetic constructs and vectors to facilitate introduction and/or expression in plants of nucleic acids encoding MSR polypeptides, or an enolase polypeptide, or ZAT-like zinc transporter polypeptides, or 6-PGDH polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

More specifically, the present invention provides a construct comprising:
(a) a nucleic acid encoding an MSR polypeptide, or an enolase polypeptide, or a ZAT-like zinc transporter polypeptide, or a 6-PGDH polypeptide, as defined above;
(b) one or more control sequences capable of driving expression of the nucleic acid sequence of (a); and optionally
(c) a transcription termination sequence.

Preferably, the nucleic acid encoding an MSR polypeptide, or an enolase polypeptide, or a ZAT-like zinc transporter polypeptide, or a 6-PGDH polypeptide, is as defined above. The term "control sequence" and "termination sequence" are as defined herein.

Plants are transformed with a vector comprising any of the nucleic acids described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to drive expression of the nucleic acid sequence, but preferably the promoter is of plant origin. A constitutive promoter is particularly useful in the methods. Preferably the constitutive promoter is also a ubiquitous promoter of medium strength. See the "Definitions" section herein for definitions of the various promoter types. Concerning enolase polypeptides, also useful in the methods of the invention is a seed-specific promoter, preferably an ABA (abcisic acid) induced promoter.

Concerning MSR polypeptides, it should be clear that the applicability of the present invention is not restricted to the MSR polypeptide-encoding nucleic acid represented by SEQ ID NO: 1, nor is the applicability of the invention restricted to expression of an MSR polypeptide-encoding nucleic acid when driven by a constitutive promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 188, most preferably the constitutive promoter is as represented by SEQ ID NO: 188. See the "Definitions" section herein for further examples of constitutive promoters.

Concerning enolase polypeptides, it should be clear that the applicability of the present invention is not restricted to the ENOLASE polypeptide-encoding nucleic acid represented by SEQ ID NO: 193, nor is the applicability of the invention restricted to expression of an Enolase polypeptide-encoding nucleic acid when driven by a constitutive promoter, or when driven by a seed-specific promoter.

The constitutive promoter is preferably a medium strength promoter, more preferably selected from a plant derived promoter, such as a GOS2 promoter, more preferably is the promoter GOS2 promoter from rice. Further preferably the constitutive promoter is represented by a nucleic acid sequence substantially similar to SEQ ID NO: 241, most preferably the constitutive promoter is as represented by SEQ ID NO: 241. Alternatively, the seed-specific promoter, preferably an ABA (abcisic acid) induced promoter is represented by a nucleic acid sequence substantially similar to SEQ ID NO: 242, most preferably the constitutive promoter is as represented by SEQ ID NO: 242.

See the "Definitions" section herein for further examples of constitutive and/or seed specific promoters.

Concerning ZAT-like zinc transporter polypeptides, it should be clear that the applicability of the present invention is not restricted to the ZAT-like zinc transporter encoding nucleic acid represented by SEQ ID NO: 247, nor is the applicability of the invention restricted to expression of a ZAT-like zinc transporter encoding nucleic acid when driven by a constitutive promoter.

The constitutive promoter is preferably a medium strength promoter, such as a GOS2 promoter, preferably the promoter is a GOS2 promoter from rice. Further preferably the constitutive promoter is represented by a nucleic acid sequence substantially similar to SEQ ID NO: 278, most preferably the constitutive promoter is as represented by SEQ ID NO: 278. See Table 2a in the "Definitions" section herein for further examples of constitutive promoters.

Optionally, one or more terminator sequences may be used in the construct introduced into a plant. Preferably, the construct comprises an expression cassette comprising a (GOS2)

promoter, substantially similar to SEQ ID NO: 278, and the nucleic acid encoding the ZAT-like zinc transporter polypeptide.

Concerning 6-PGDH polypeptides, it should be clear that the applicability of the present invention is not restricted to the 6-PGDH polypeptide-encoding nucleic acid represented by SEQ ID NO: 281, nor is the applicability of the invention restricted to expression of a 6-PGDH polypeptide-encoding nucleic acid when driven by a constitutive specific promoter.

The constitutive promoter is preferably a medium strength promoter, such as a GOS2 promoter, preferably the promoter is a GOS2 promoter from rice. Further preferably the constitutive promoter is represented by a nucleic acid sequence substantially similar to SEQ ID NO: 286, most preferably the constitutive promoter is as represented by SEQ ID NO: 286. See Table 2 in the "Definitions" section herein for further examples of constitutive promoters.

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

The invention also provides a method for the production of transgenic plants having enhanced yield-related traits relative to control plants, comprising introduction and expression in a plant of any nucleic acid encoding an MSR polypeptide, or an enolase polypeptide, or a ZAT-like zinc transporter polypeptide, or a 6-PGDH polypeptide, as defined hereinabove.

More specifically, the present invention provides a method for the production of transgenic plants having enhanced yield-related traits, particularly increased (seed) yield, which method comprises:
  (i) introducing and expressing in a plant or plant cell a nucleic acid encoding an MSR polypeptide, or an enolase polypeptide, or a ZAT-like zinc transporter polypeptide; and
  (ii) cultivating the plant cell under conditions promoting plant growth and development.

The nucleic acid of (i) may be any of the nucleic acids capable of encoding an MSR polypeptide, or an enolase polypeptide, or a ZAT-like zinc transporter polypeptide, as defined herein.

Even more specifically, the present invention provides a method for the production of transgenic plants having increased enhanced yield-related traits, particularly increased early vigour and/or increased yield, which method comprises:
  (i) introducing and expressing in a plant or plant cell a 6-PGDH polypeptide-encoding nucleic acid; and
  (ii) cultivating the plant cell under conditions promoting plant growth and development.

The nucleic acid of (i) may be any of the nucleic acids capable of encoding a 6-PGDH polypeptide as defined herein.

The nucleic acid may be introduced directly into a plant cell or into the plant itself (including introduction into a tissue, organ or any other part of a plant). According to a preferred feature of the present invention, the nucleic acid is preferably introduced into a plant by transformation. The term "transformation" is described in more detail in the "definitions" section herein.

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

The present invention clearly extends to any plant cell or plant produced by any of the methods described herein, and to all plant parts and propagules thereof. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding an MSR polypeptide, or an enolase polypeptide, or a ZAT-like zinc transporter polypeptide, or a 6-PGDH polypeptide, as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, *sorghum*, emmer, spelt, *secale*, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding an MSR polypeptide, or an enolase polypeptide, or a ZAT-like zinc transporter polypeptide, or a 6-PGDH polypeptide. The invention furthermore relates to products derived, preferably directly derived, from a harvestable part of such a plant, such as dry pellets or powders, oil, fat and fatty acids, starch or proteins.

According to a preferred feature of the invention, the modulated expression is increased expression. Methods for increasing expression of nucleic acids or genes, or gene products, are well documented in the art and examples are provided in the definitions section.

As mentioned above, a preferred method for modulating expression of a nucleic acid encoding an MSR polypeptide, or an enolase polypeptide, or a ZAT-like zinc transporter polypeptide, or a 6-PGDH polypeptide, is by introducing and expressing in a plant a nucleic acid encoding an MSR polypeptide, or an enolase polypeptide, or a ZAT-like zinc transporter polypeptide, or a 6-PGDH polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention also encompasses use of nucleic acids encoding MSR polypeptides, or enolase polypeptides, or ZAT-like zinc transporter polypeptides, or 6-PGDH polypeptides, as described herein and use of these MSR polypeptides, or enolase polypeptides, or ZAT-like zinc transporter polypeptides, or 6-PGDH polypeptides, in enhancing any of the aforementioned yield-related traits in plants.

Nucleic acids encoding MSR polypeptides, or enolase polypeptides, or ZAT-like zinc transporter polypeptides, or 6-PGDH polypeptides, described herein, or the MSR polypeptides themselves, may find use in breeding programmes in which a DNA marker is identified which may be genetically linked to a gene encoding MSR polypeptides, or enolase polypeptides, or ZAT-like zinc transporter polypeptides, or 6-PGDH polypeptides. The nucleic acids/genes, or the MSR polypeptides, or enolase polypeptides, or ZAT-like zinc transporter polypeptides, or 6-PGDH polypeptides, themselves may be used to define a molecular marker. This DNA or protein marker may then be used in breeding programmes to select plants having enhanced yield-related traits as defined hereinabove in the methods of the invention.

Allelic variants of a nucleic acid/gene encoding MSR polypeptides, or enolase polypeptides, or ZAT-like zinc transporter polypeptides, or 6-PGDH polypeptides, may also find use in marker-assisted breeding programmes. Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Nucleic acids encoding MSR polypeptides, or enolase polypeptides, or ZAT-like zinc transporter polypeptides, or 6-PGDH polypeptides, may also be used as probes for genetically and physically mapping the genes that they are a part of, and as markers for traits linked to those genes. Such information may be useful in plant breeding in order to develop lines with desired phenotypes. Such use of nucleic acids encoding MSR polypeptides, or enolase polypeptides, or ZAT-like zinc transporter polypeptides, or 6-PGDH polypeptides, requires only a nucleic acid sequence of at least 15 nucleotides in length. The nucleic acids encoding MSR polypeptides, or enolase polypeptides, or ZAT-like zinc transporter polypeptides, or 6-PGDH polypeptides, may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the nucleic acids encoding MSR polypeptides, or enolase polypeptides, or ZAT-like zinc transporter polypeptides, or 6-PGDH polypeptides. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the nucleic acid encoding MSR polypeptides, or enolase polypeptides, or ZAT-like zinc transporter polypeptides, or 6-PGDH polypeptides, in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

Concerning 6-PGDH polypeptides, as shown in the present invention, modulated expression of a nucleic acid encoding a 6-PGDH protein as defined above, in a specific spatial and temporal expression pattern gives plants having improved yield-related traits. This information can be used in a screen for identifying a compound or a composition of compounds that modulates the activity of a regulatory sequence (for example a promoter), resulting in a desired expression pattern of a 6-PGDH operably linked to that regulatory sequence in methods for improving yield-related traits in a plant. Preferably, the expression pattern is the one that is used in the methods of the present invention. By operably linking a regulatory sequence (such as the native promoter of a 6-PGDH gene) to a reporter gene, chemicals (alone or in combination) are tested for their impact on the expression pattern of the reporter gene. Chemical compounds that induce a desired expression pattern are retained as candidate modulators of 6-PGDH expression in methods for improving yield-related traits. A high throughput screen may be applied for testing large amounts of chemical compounds, since the expression pattern of the reporter gene can be used as an indicator of the yield increase. The invention thus provides use of 6-PGDH encoding nucleic acids and/or of regulatory sequences of 6-PGDH genes in such screens.

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

The methods according to the present invention result in plants having enhanced yield-related traits, as described hereinbefore. These traits may also be combined with other economically advantageous traits, such as further yield-enhancing traits, tolerance to other abiotic and biotic stresses, traits modifying various architectural features and/or biochemical and/or physiological features.

Items

The present invention will now be described in reference to the following items:

1. Methionine Sulfoxide Reductase (Msr)
1. A method for enhancing yield-related traits in plants relative to control plants, comprising modulating expression in a plant of a nucleic acid encoding an MSR polypeptide, wherein said MSR polypeptide has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more amino acid sequence identity to any of the polypeptide sequences given in Table A1 herein.
2. Method according to item 1, wherein said MSR polypeptide comprises at least one conserved protein motif having in increasing order of preference 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one of:
   (i) Motif 1 as represented by SEQ ID NO: 173: (Q)(Y)(R)(S);
   (ii) Motif 2 as represented by SEQ ID NO: 174: (Y/H/E/D/G)(H/S)(Q/R)(Q/K/R) (Y/F)(L/C/E);
   (iii) Motif 3 as represented by SEQ ID NO: 175: (I/V)(V/M/I/A/R/F/T)(T/V/R) (E/D/T) (I/V/Q)(L/K/A/V/I)(P/G/T/K)(A/S/P/T/Q);
   (iv) Motif 4 as represented by SEQ ID NO: 176: (A/F/T/-)(Q/V/E/S/C/T/-)(F/I/A/-)(G/A/-) (A/L/S/T/-)(G/-)(C/S/-)(F/-)(W/-)(G/R/S/-)(V/S/G/-)(E/-)(L/-)(A/M/G/V/T/-)(F/C/A/Y/-) (Q/W/R/G/-)(R/C/E/-)(V/I/L/S/A/-)(P/H/R/N/S/-)(G/-)(V/L/-)(T/V/I/Y/R/A/-)(K/R/E/S/A/Y/Q/V/-)(T/A/-)(E/S/R/A/-)(V/A/-)(G/-)(Y/-)(T/S/A/V/I/-)(Q/G/A/H/-)(G/-)(N/S/L/H/K/A/D/Q/-)(L/K/S/T/I/V/F/R/M/-)(H/T/A/S/Q/K/E/P/D/-)(N/D/H/R/G/E/M/-)(P/-)(T/S/L/N/D/-)(Y/-)(E/R/K/Y/G/Q/-)(D/A/L/-)(V/E/D/A/I/-)(C/Y/-)(T/S/R/H/G/-)(G/N/S/-)(A/L/V/Q/R/K/T/D/M/-)(T/G/A/-)(Y/D/G/V/S/K/-)(H/-)(S/A/T/V/N/M)(E/Q) (V/S/F/A/G/C)(V/L/D)(R/Q/E/K/Y)(V/I/L/M)(Q/H/E/T/V/I)(Y/F)(D/N)(P/V/L)(K/R/S/Q/A/N)(A/V/L/I/M/Q/E/D/N)(C/I/V/G)(K/P/K/T/G/Q/H)(Y/F)(D/R/S/K/T/E/Q)(D/Q/K/N/T/V/S)(L/I)(L/V) (D/E/S/A/K)(V/F/I/L/M/A/T)(F/H/L)(W/Y)(A/S/Q/K/T/D/N)(R/K/S/M/N)(H)(D/N)(P/S)(T/R)(T/Q/E/A)(L/P/V/I/G/K/F)(N/F/H/M/D)(R/G)(Q)(G/V)(N/P/G/A/E)(D/L)(V/Q/R/L/S)(G)(T/N/A/S/P)(Q)(Y)(R)(S)(G/V/A/C/I)(I/V/L)(Y/F)(Y/T/F/C)(Y/N/H/Q/T/S);
   (v) Motif 5 as represented by SEQ ID NO: 177: (G)(W)(P);
   (vi) Motif 6 as represented by SEQ ID NO: 178: (L/V)(Y/F/L)(K/D/E/Q/S/R)(S/T/-)(T/S/A/I/L/K/D/-)(T/A/-)(K/-)(F/-)(D/N/-)(S/A/R)(G/P);
   (vii) Motif 7 as represented by SEQ ID NO: 179: (G/D/E/N/-)(G/A/S/I/-)(H/F/-)(L/F/-)(G/F/C/-)(H/F)(V/I/S)(F/T/H/L/V) (K/D/P/M/L/I/R);
   (viii) Motif 8 as represented by SEQ ID NO: 180: (K/R/L/T/W/L/F/I/-)(S/T/R/Q/P/K/G/-) (E/D/N/A/T/K/-)(E/A/Q/A/G/R/-)(E/D/R/-)((W/L/Q/-)(R/K/A/V/E/Q/-)(A/V/K/T/Q/R/-) (V/I/Q/R/K/G/-)(L/A/-)(S/T/E/N/-)(P/D/S/Q/A/N/E/K/-)(E/D/Q/A/-)(Q/E/A)(F/Y/R/-)(R/Y/H/K/T/Q/-)(I/V/-)(L/T/A/-)(R/L/-)(Q/K/L/D/R/E/H/-)(K/

A/E/H/-)(G/M/S/A)(T/I/S)(E/D/R)(R/A/K/N/Y/T/I/P/
F/L)(P/A/K/Q/R/A)(G/F/N)(T/S/K/C)(G/S/E)(E/P/V/
R)(Y/F/L)(N/D/W/V/T/L/E)(K/N/Q/D)(F/T/N/V/L/K/
E/S)(F/W/Y/K/H/D/S)(T/N/A/G/E/D/K/R)(E/P/A/D/
K/Q/V)(G)(I/V/A/T)(Y/F);

(ix) Motif 9 as represented by SEQ ID NO: 181: (C)(A/V/
I/R)(G/C/L)(C) (G/A/D/N/K/Q/E)(T/S/A/L/N)(P/A/D/
K)(L/V)(Y/F/L)(K/E/D/Q/S/R)(S/-)(T/S/K/D/A/I/L);

(x) Motif 10 as represented by SEQ ID NO: 182: (A/S)(F/
Y)(F/Y/W/D)(E/Q/D/R/A) (G/P/T/A)(I/V/L/F)(G/P/A/
D)(G/A/P/N/D/K/E)(A/N/T)(I/V/H)(N/K/T/G/V/I/A)
(R/Q/S/E/T)(T/K/H/I/E/A/S/N)(P/L/R/T/A/M/V/I/E)
(D/E/R/I/G/N)(P/L/A/D/R/W/M)(D/E/S/T/A/G/-)(G/I/
S/F/H/-)(R/I/F/P/G/H/L/K/M/-)(R/F/S/G/M/-)(M/V/Y/
I/T/-)(P/R/V/-)(R/-)(Q/T/-)(E/A/-)(I/V/S/T/-)(T/L/I/V/
H/N/-)(C/-);

(xi) Motif 11 as represented by SEQ ID NO: 183: (G/A/S/
I/-)(H/F/-)(L/F/-)(G/F/C/-)(H/F)(V/I/S)(F/T/H/L/V)(K/
D/P/M/L/I/R)(G/D/N/T/V)(E/G/R/H)(G/P/V/D/W/S)
(F/P/H/Y/I/N/R/S)(S/L/P/A/D/G/K/R-)(T/R/N/V/-)(P/
D/A/F/T/-)(T/L/F/S/R)(D/G/L/Y/N)(E/K/A/N/Q/L)
(R/K/D/E/A/P)(H/Y/I/L/K/C/F) (C/V/-)(V/L/I/S/M/-)
(N/Q/K/L/-)(S/L/Q/R/-)(V/I/A/R/Y/-);

wherein the amino acid at each position is given between brackets and "-" represents a gap, that is, the absence of an amino acid at said position.

3. Method according to item 1 or 2, wherein said modulated expression is effected by introducing and expressing in a plant a nucleic acid encoding an MSR polypeptide.

4. Method according to any one of items 1 to 3, wherein said nucleic acid encoding an MSR polypeptide encodes any one of the proteins listed in Table A1 or is a portion of such a nucleic acid, or a nucleic acid capable of hybridising with such a nucleic acid.

5. Method according to any one of items 1 to 4, wherein said nucleic acid sequence encodes an orthologue or paralogue of any of the proteins given in Table A1.

6. Method according to any preceding item, wherein said enhanced yield-related traits comprise increased yield, preferably increased biomass and/or increased seed yield relative to control plants.

7. Method according to any one of items 1 to 6, wherein said enhanced yield-related traits are obtained under non-stress conditions.

8. Method according to any one of items 1 to 6, wherein said enhanced yield-related traits are obtained under conditions of drought stress, salt stress or nitrogen deficiency.

9. Method according to any one of items 3 to 8, wherein said nucleic acid is operably linked to a constitutive promoter, preferably to a GOS2 promoter, most preferably to a GOS2 promoter from rice.

10. Method according to any one of items 1 to 9, wherein said nucleic acid encoding an MSR polypeptide is of plant origin, preferably from a monocotyledonous plant, more preferably from the genus *Oryza*, most preferably from *Oryza sativa* or from a dycotyledoneous plant, more preferably from the genus *Medicago*, most preferably from *Medicago truncatula*.

11. Plant or part thereof, including seeds, obtainable by a method according to any one of items 1 to 10, wherein said plant or part thereof comprises a recombinant nucleic acid encoding an MSR polypeptide.

12. Construct comprising:
    (a) nucleic acid encoding an MSR polypeptide as defined in items 1, 2 or 22;
    (b) one or more control sequences capable of driving expression of the nucleic acid sequence of (a); and optionally
    (c) a transcription termination sequence.

13. Construct according to item 12, wherein one of said control sequences is a constitutive promoter, preferably a GOS2 promoter, most preferably a GOS2 promoter from rice.

14. Use of a construct according to item 12 or 13 in a method for making plants having increased yield, particularly increased biomass and/or increased seed yield relative to control plants.

15. Plant, plant part or plant cell transformed with a construct according to item 12 or 13.

16. Method for the production of a transgenic plant having increased yield, particularly increased biomass and/or increased seed yield relative to control plants, comprising:
    (i) introducing and expressing in a plant a nucleic acid encoding an MSR polypeptide as defined in item 1 or 2; and
    (ii) cultivating the plant cell under conditions promoting plant growth and development.

17. Transgenic plant having increased yield, particularly increased biomass and/or increased seed yield, relative to control plants, resulting from modulated expression of a nucleic acid encoding an MSR polypeptide as defined in item 1 or 2, or a transgenic plant cell derived from said transgenic plant.

18. Transgenic plant according to item 11, 15 or 17, or a transgenic plant cell derived thereof, wherein said plant is a crop plant or a monocot or a cereal, such as rice, maize, wheat, barley, millet, rye, triticale, *sorghum* emmer, spelt, *secale*, einkorn, teff, milo and oats.

19. Harvestable parts of a plant according to item 18, wherein said harvestable parts are preferably shoot biomass and/or seeds.

20. Products derived from a plant according to item 18 and/or from harvestable parts of a plant according to item 19.

21. Use of a nucleic acid encoding an MSR polypeptide in increasing yield, particularly in increasing seed yield and/or shoot biomass in plants, relative to control plants.

22. An isolated nucleic acid molecule selected from:
    (i) a nucleic acid represented by any one of SEQ ID NO: 31, 33, 41, 105, 107, 109, 113, 115, 117, 119, 121, 123, 125, 165, 167, 169, and SEQ ID NO: 171;
    (ii) the complement of a nucleic acid represented by any one of SEQ ID NO: 31, 33, 41, 105, 107, 109, 113, 115, 117, 119, 121, 123, 125, 165, 167, 169, and SEQ ID NO: 171;
    (iii) a nucleic acid encoding the polypeptide as represented by any one of SEQ ID NO: 32, 34, 42, 106, 108, 110, 114, 116, 118, 120, 122, 124, 126, 166, 168, 170, and SEQ ID NO: 172, preferably as a result of the degeneracy of the genetic code, said isolated nucleic acid can be derived from a polypeptide sequence as represented by any one of SEQ ID NO: 32, 34, 42, 106, 108, 110, 114, 116, 118, 120, 122, 124, 126, 166, 168, 170, and SEQ ID NO: 172, and further preferably confers enhanced yield-related traits relative to control plants;
    (iv) a nucleic acid having, in increasing order of preference at least 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A1 and further preferably conferring enhanced yield-related traits relative to control plants;
(v) a nucleic acid molecule which hybridizes with a nucleic acid molecule of (i) to (iv) under stringent hybridization conditions and preferably confers enhanced yield-related traits relative to control plants;
(vi) a nucleic acid encoding an MSR polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 32, 34, 42, 106, 108, 110, 114, 116, 118, 120, 122, 124, 126, 166, 168, 170, and SEQ ID NO: 172, and any of the other amino acid sequences in Table A1 and preferably conferring enhanced yield-related traits relative to control plants.

23. An isolated polypeptide selected from:
   (i) an amino acid sequence represented by any one of SEQ ID NO: 32, 34, 42, 106, 108, 110, 114, 116, 118, 120, 122, 124, 126, 166, 168, 170, and SEQ ID NO: 172;
   (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 32, 34, 42, 106, 108, 110, 114, 116, 118, 120, 122, 124, 126, 166, 168, 170, and SEQ ID NO: 172 or any of the other amino acid sequences in Table A1 and preferably conferring enhanced yield-related traits relative to control plants.
   (iii) derivatives of any of the amino acid sequences given in (i) or (ii) above.

2. Enolase (2-phospho-D-glycerate hydrolase)

1. A method for enhancing yield-related traits in plants relative to control plants, comprising modulating expression in a plant of a nucleic acid encoding an Enolase polypeptide, wherein said Enolase polypeptide comprises a protein domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% amino acid sequence identity to:
   (i) a Conserved Enolase N Domain as represented by SEQ ID NO: 235 with a Pfam accession reference PF00113; and to
   (ii) a Conserved Enolase C Domain as represented by SEQ ID NO: 236 with a Pfam accession reference PF03952; and optionally
   (iii) having Enolase (2-phospho-D-glycerate hydro-lyase) activity and/or
   (iv) selecting for plants having enhanced yield-related traits.

2. Method according to item 1, wherein said Enolase polypeptide comprises one or more of the following motifs:
   (i) Motif 12: SIE(D/Q)PFD (SEQ ID NO: 237);
   (ii) Motif 13: VGDDLL (SEQ ID NO: 238);
   (iii) Motif 14: GAPCR (SEQ ID NO: 239);
   (iv) Motif 15: KYNQ(L/I)LRIE (SEQ ID NO: 240), wherein X represents any amino acid; and
   wherein any amino acid may be substituted by a conserved amino acid residue according to Table 1.

3. Method according to item 1 or 2, wherein said modulated expression is effected by introducing and expressing in a plant a nucleic acid encoding an Enolase polypeptide.

4. Method according to any one of items 1 to 3, wherein said nucleic acid encoding an Enolase polypeptide encodes any one of the proteins listed in Table A2 or is a portion of such a nucleic acid, or a nucleic acid capable of hybridising with such a nucleic acid.

5. Method according to any one of items 1 to 4, wherein said nucleic acid sequence encodes an orthologue or paralogue of any of the proteins given in Table A2.

6. Method according to any preceding item, wherein said enhanced yield-related traits comprise increased yield, preferably increased biomass and/or increased seed yield relative to control plants.

7. Method according to any one of items 1 to 6, wherein said enhanced yield-related traits are obtained under non-stress conditions.

8. Method according to any one of items 1 to 6, wherein said enhanced yield-related traits are obtained under conditions of drought stress.

9. Method according to any one of items 3 to 8, wherein said nucleic acid is operably linked to any one of:
   (i) a constitutive promoter, preferably to a GOS2 promoter, most preferably to a GOS2 promoter from rice;
   (ii) a seed specific promoter, preferably to a WSI18 promoter, most preferably to a WSI18 promoter from rice;

10. Method according to any one of items 1 to 9, wherein said nucleic acid encoding an Enolase polypeptide is of plant origin, preferably from a monocotyledonous plant, further preferably from the family Poaceae, more preferably from the genus Oryza, most preferably from Oryza sativa.

11. Plant or part thereof, including seeds, obtainable by a method according to any one of items 1 to 10, wherein said plant or part thereof comprises a recombinant nucleic acid encoding an Enolase polypeptide.

12. Construct comprising:
   (i) nucleic acid encoding an Enolase polypeptide as defined in items 1 or 2;
   (ii) one or more control sequences capable of driving expression of the nucleic acid sequence of (a); and optionally
   (iii) a transcription termination sequence.

13. Construct according to item 12, wherein one of said control sequences is:
   (i) a constitutive promoter, preferably a GOS2 promoter, most preferably a GOS2 promoter from rice or
   (ii) A seed preferred promoter, preferably a WSi18 promoter, most preferably a WSI18 promoter from rice 14. Use of a construct according to item 12 or 13 in a method for making plants having increased yield, particularly increased biomass and/or increased seed yield relative to control plants.

15. Plant, plant part or plant cell transformed with a construct according to item 12 or 13.

16. Method for the production of a transgenic plant having increased yield, particularly increased biomass and/or increased seed yield relative to control plants, comprising:
   (i) introducing and expressing in a plant a nucleic acid encoding an Enolase polypeptide as defined in item 1 or 2; and
   (ii) cultivating the plant cell under conditions promoting plant growth and development.
17. Transgenic plant having increased yield, particularly increased biomass and/or increased seed yield, relative to control plants, resulting from modulated expression of a nucleic acid encoding an Enolase polypeptide as defined in item 1 or 2, or a transgenic plant cell derived from said transgenic plant.
18. Transgenic plant according to item 11, 15 or 17, or a transgenic plant cell derived thereof, wherein said plant is a crop plant or a monocot or a cereal, such as rice, maize, wheat, barley, millet, rye, triticale, *sorghum* emmer, spelt, *secale*, einkorn, teff, milo and oats.
19. Harvestable parts of a plant according to item 18, wherein said harvestable parts are preferably shoot biomass and/or seeds.
20. Products derived from a plant according to item 18 and/or from harvestable parts of a plant according to item 19.
21. Use of a nucleic acid encoding an Enolase polypeptide in increasing yield, particularly in increasing seed yield and/or shoot biomass in plants, relative to control plants.
23. An isolated nucleic acid molecule selected from:
   (i) a nucleic acid represented by any one of SEQ ID NO: 215 and 217;
   (ii) the complement of a nucleic acid represented by any one of SEQ ID NO: 215 and 217;
   (iii) a nucleic acid encoding the polypeptide as represented by any one of SEQ ID NO: 216 and 218, preferably as a result of the degeneracy of the genetic code, said isolated nucleic acid can be derived from a polypeptide sequence as represented by any one of SEQ ID NO: 216 and 218 and further preferably confers enhanced yield-related traits relative to control plants;
   (iv) a nucleic acid having, in increasing order of preference at least 30%, 31%, 32%, 33%, 34%, 35%, 36%, 37%, 38%, 39%, 40%, 41%, 42%, 43%; 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity with any of the nucleic acid sequences of Table A2 and further preferably conferring enhanced yield-related traits relative to control plants;
   (v) a nucleic acid molecule which hybridizes with a nucleic acid molecule of (i) to (iv) under stringent hybridization conditions and preferably confers enhanced yield-related traits relative to control plants;
   (vi) a nucleic acid encoding a Enolase polypeptide having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 216 and 218 and any of the other amino acid sequences in Table A2 and preferably conferring enhanced yield-related traits relative to control plants.
23. An isolated polypeptide selected from:
   (i) an amino acid sequence represented by any one of SEQ ID NO: 216 and 218;
   (ii) an amino acid sequence having, in increasing order of preference, at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence represented by any one of SEQ ID NO: 216 and 218 and any of the other amino acid sequences in Table A2 and preferably conferring enhanced yield-related traits relative to control plants.
   (iii) derivatives of any of the amino acid sequences given in (i) or (ii) above.

3. Zn Transporter of *Arabidopsis thaliana* (ZAT)

1. A method for enhancing yield-related traits in plants relative to control plants, comprising modulating expression in a plant of a nucleic acid encoding a ZAT-like zinc transporter polypeptide comprising in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% overall sequence identity to the amino acid represented by SEQ ID NO: 249.
2. Method according to item 1, wherein said ZAT-like zinc transporter polypeptide which when used in the construction of a phylogenetic tree, such as the one depicted in FIG. 7, clusters with the group of ZAT-like zinc transporter polypeptides comprising the amino acid sequence represented by SEQ ID NO: 249 rather than with any other group.
3. Method according to item 1 or 2, wherein said modulated expression is effected by introducing and expressing in a plant a nucleic acid encoding a ZAT-like zinc transporter polypeptide.
4. Method according to any preceding item, wherein said nucleic acid encoding a ZAT-like zinc transporter polypeptide encodes any one of the proteins listed in Table A3 or is a portion of such a nucleic acid, or a nucleic acid capable of hybridising with such a nucleic acid.
5. Method according to any preceding item, wherein said nucleic acid sequence encodes an orthologue or paralogue of any of the proteins given in Table A3.
6. Method according to any preceding item, wherein said enhanced yield-related traits comprise increased yield, preferably increased biomass and/or increased seed yield relative to control plants.
7. Method according to any one of items 1 to 6, wherein said enhanced yield-related traits are obtained under non-stress conditions.
8. Method according to any one of items 3 to 8, wherein said nucleic acid is operably linked to a constitutive promoter, preferably to a GOS2 promoter, most preferably to a GOS2 promoter from rice.
9. Method according to any preceding item, wherein said nucleic acid encoding a ZAT-like zinc transporter polypeptide is of plant origin, preferably from a dicotyledonous plant, further preferably from the family Brassicaceae, more preferably from the genus *Arabidopsis*, most preferably from *Arabidopsis thaliana*.
10. Plant or part thereof, including seeds, obtainable by a method according to any preceding item, wherein said plant or part thereof comprises a recombinant nucleic acid encoding a ZAT-like zinc transporter polypeptide.

11. Construct comprising:
   (a) nucleic acid encoding a ZAT-like zinc transporter polypeptide as defined in item 1 or 2;
   (b) one or more control sequences capable of driving expression of the nucleic acid sequence of (a); and optionally
   (c) a transcription termination sequence.

12. Construct according to item 11, wherein one of said control sequences is a constitutive promoter, preferably a GOS2 promoter, most preferably a GOS2 promoter from rice.

13. Use of a construct according to item 11 or 12 in a method for making plants having increased yield, particularly increased biomass and/or increased seed yield relative to control plants.

14. Plant, plant part or plant cell transformed with a construct according to item 11 or 12.

15. Method for the production of a transgenic plant having increased yield, particularly increased biomass and/or increased seed yield relative to control plants, comprising:
   (i) introducing and expressing in a plant a nucleic acid encoding a ZAT-like zinc transporter polypeptide as defined in item 1 or 2; and
   (ii) cultivating the plant cell under conditions promoting plant growth and development.

16. Transgenic plant having increased yield, particularly increased biomass and/or increased seed yield, relative to control plants, resulting from modulated expression of a nucleic acid encoding a ZAT-like zinc transporter polypeptide as defined in item 1 or 2, or a transgenic plant cell derived from said transgenic plant.

17. Transgenic plant according to item 10, 14 or 16, or a transgenic plant cell derived thereof, wherein said plant is a crop plant or a monocot or a cereal, such as rice, maize, wheat, barley, millet, rye, triticale, *sorghum* emmer, spelt, *secale*, einkorn, teff, milo and oats.

18. Harvestable parts of a plant according to item 17, wherein said harvestable parts are preferably shoot biomass and/or seeds.

19. Products derived from a plant according to item 17 and/or from harvestable parts of a plant according to item 18.

20. Use of a nucleic acid encoding a ZAT-like zinc transporter polypeptide in increasing yield, particularly in increasing seed yield and/or shoot biomass in plants, relative to control plants.

4. 6-Phosphogluconate Dehydrogenase (6-PGDH)

1. A method for enhancing yield-related traits, preferably enhancing seed yield-related traits, in plants relative to control plants, comprising modulating expression in a plant of a nucleic acid sequence encoding a 6-PGDH polypeptide.

2. A method according to item 1, wherein said 6-PGDH polypeptide comprises a protein domain having 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the following domains:
   (i) the 6-phosphogluconate dehydrogenase domain located between amino acid positions 3 to 178 in SEQ ID NO: 282;
   (ii) the conserved 6-phosphogluconate dehydrogenase C-terminal domain located between amino acid positions amino acid positions 182 to 472 in SEQ ID NO: 282, 3. Method according to item 1 or 2, wherein said 6-PGDH polypeptide has in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% amino acid sequence identity to the 6-PGDH polypeptide as represented by SEQ ID NO: 282.

4. Method according to any preceding item, wherein said nucleic acid sequence encoding a 6-PGDH polypeptide is represented by the nucleic acid sequence of SEQ ID NO: 281 or a portion thereof, or a sequence capable of hybridising with the nucleic acid sequence of SEQ ID NO: 281 or a portion thereof.

5. Method according to any preceding item wherein said modulated expression (preferably, increased) is effected by introducing and expressing in a plant a nucleic acid sequence encoding said 6-PGDH polypeptide.

6. Method according to any preceding item, wherein said enhanced yield-related traits comprise one or more of: increased biomass, increased total seed yield per plant, increased number of filled seeds, increased seed filling rate and increased early vigour relative to control plants.

7. Method according to any preceding item, wherein said modulated expression is increased expression.

8. Method according to any preceding item, wherein said nucleic acid sequence is operably linked to a constitutive promoter, preferably to a GOS2 promoter, most preferably to a GOS2 promoter from rice.

9. Method according to any preceding item, wherein said nucleic acid sequence encoding a 6-PGDH polypeptide is of plant origin, preferably from a dicotyledonous plant, further preferably from the family Poaceae, more preferably from *Oryza sativa*.

10. Plant, part thereof (including seeds), or plant cell obtainable by a method according to any preceding item, wherein said plant, part thereof, or plant cell comprises a nucleic acid transgene encoding a 6-PGDH polypeptide.

11. Construct comprising:
   (i) nucleic acid sequence encoding a 6-PGDH polypeptide as defined in items 1 to 3;
   (ii) one or more control sequences capable of driving expression of the nucleic acid sequence of (a); and optionally
   (iii) a transcription termination sequence.

12. Construct according to item 11, wherein one of said control sequences is a constitutive promoter, preferably a GOS2 promoter, most preferably an GOS2 promoter from rice.

13. Use of a construct according to any of items 11 or 12 in a method for making plants having enhanced yield-related traits, particularly increased biomass, increased total seed yield per plant, increased number of filled seeds, increased seed filling rate and increased early vigour relative to control plants.

14. Plant, plant part or plant cell transformed with a construct according to any of items 11 or 12.

15. Method for the production of a transgenic plant having enhanced-yield related traits relative to control plants, comprising:

(i) introducing and expressing in a plant, plant part, or plant cell, a nucleic acid sequence encoding a 6-PGDH polypeptide as defined in items 1 to 3; and (ii) cultivating the plant, plant part, or plant cell under conditions promoting plant growth and development.

16. Transgenic plant having enhanced yield-related traits, particularly increased biomass, increased total seed yield per plant, increased number of filled seeds, increased seed filling rate and increased early vigour relative to control plants, resulting from increased expression of a nucleic acid sequence encoding a 6-PGDH polypeptide as defined in items 1 to 3, or a transgenic plant cell derived from said transgenic plant.

17. Transgenic plant according to item 10, 14 or 16, or a transgenic plant cell derived thereof, wherein said plant is a crop plant or a monocot or a cereal, such as rice, maize, wheat, barley, millet, rye, triticale, *sorghum* and oats.

18. Harvestable parts of a plant comprising a nucleic acid sequence encoding a 6-PGDH polypeptide according to item 17, wherein said harvestable parts are preferably seeds.

19. Products derived from a plant according to item 17 and/or from harvestable parts of a plant according to item 18.

20. Use of a nucleic acid sequence encoding a 6-PGDH polypeptide in enhancing yield-related traits in plants, particularly in increased biomass, increased total seed yield per plant, increased number of filled seeds, increased seed filling rate and increased early vigour relative to control plants.

DESCRIPTION OF FIGURES

The present invention will now be described with reference to the following figures in which:

FIG. 1 represents a multiple alignment of MSR polypeptides. The name of the polypeptide sequences in the alignment is as follows: PF61417, underscore (_), SEQ ID NO and the plant from which the sequence originates (e.g. PF61417_2_Oryza).

FIG. 3 represents of the Enolase polypeptides of Table A2. AT1G74030: SEQ ID NO: 220; Pt scaff_XII.488: SEQ ID NO: 230; Os LOC_Os09g20820.1: SEQ ID NO: 204; Zm_enolase_2: SEQ ID NO: 212; AT2G29560: SEQ ID NO: 222. Pt scaff_IX.1243: SEQ ID NO: 228; Os LOC_Os03g15950.1: SEQ ID NO: 200; Ot enolase: SEQ ID NO: 234; AT2G36530.1: SEQ ID NO: 224; Gm enolase Hyseq_2: SEQ ID NO: 218; Pt scaff_28.296: SEQ ID NO: 226; Gm enolase Hyseq: SEQ ID NO: 216; Pt scaff_XV.1093: SEQ ID NO: 232; enolase TM: SEQ ID NO: 194; Os LOC_Os10g08550: SEQ ID NO: 206; Hv enolase: SEQ ID NO: 214; Zm enolase_1: SEQ ID NO: 208; Os LOC_Os03g14450.1: SEQ ID NO: 196; Os LOC_Os03g14450.2: SEQ ID NO: 198; Os LOC_Os06g04510.1: SEQ ID NO: 202; Zm enolase_3: SEQ ID NO: 210; and Consensus: SEQ ID NO: 387.

FIG. 6 shows the sequence alignment between various ZAT-like zinc transporter polypeptides and related sequences. *A.thaliana*_AT2G04620: SEQ ID NO: 388; *P.tricomutum*_23557: SEQ ID NO: 389; *A.thaliana*_AT2G29410: SEQ ID NO: 390; *V.vinifera*_GS-VIVT24226001: SEQ ID NO: 391; *P.patens*_119800: SEQ ID NO: 392; *P.patens*_58387: SEQ ID NO: 393; *C.tinctorius*_TA2425: SEQ ID NO: 255; *O.sativa*_Os05g03780: SEQ ID NO: 273; *Z.mays*_TA176521: SEQ ID NO: 277; *E.grandis*_AF197329: SEQ ID NO: 257; *I.nil*_TA6615: SEQ ID NO: 259; *N.benthamiana*_TA8245: SEQ ID NO: 261; *N.tabacum*_TA14631: SEQ ID NO: 263; *P.trichocarpa*_II672: SEQ ID NO: 267; *P.trichocarpa*_XIV.515: SEQ ID NO: 271; *A.thaliana*_AT3G61940: SEQ ID NO: 253; *A.thaliana*_AT2G46800: SEQ ID NO: 249; *T.caerulescens*_TA62: SEQ ID NO: 275; *A.thaliana*_AT3G58810: SEQ ID NO: 251; *P.trichocarpa*_1910: SEQ ID NO: 265; and *P.trichocarpa*_XI272: SEQ ID NO: 269.

EXAMPLES

Figure 2:
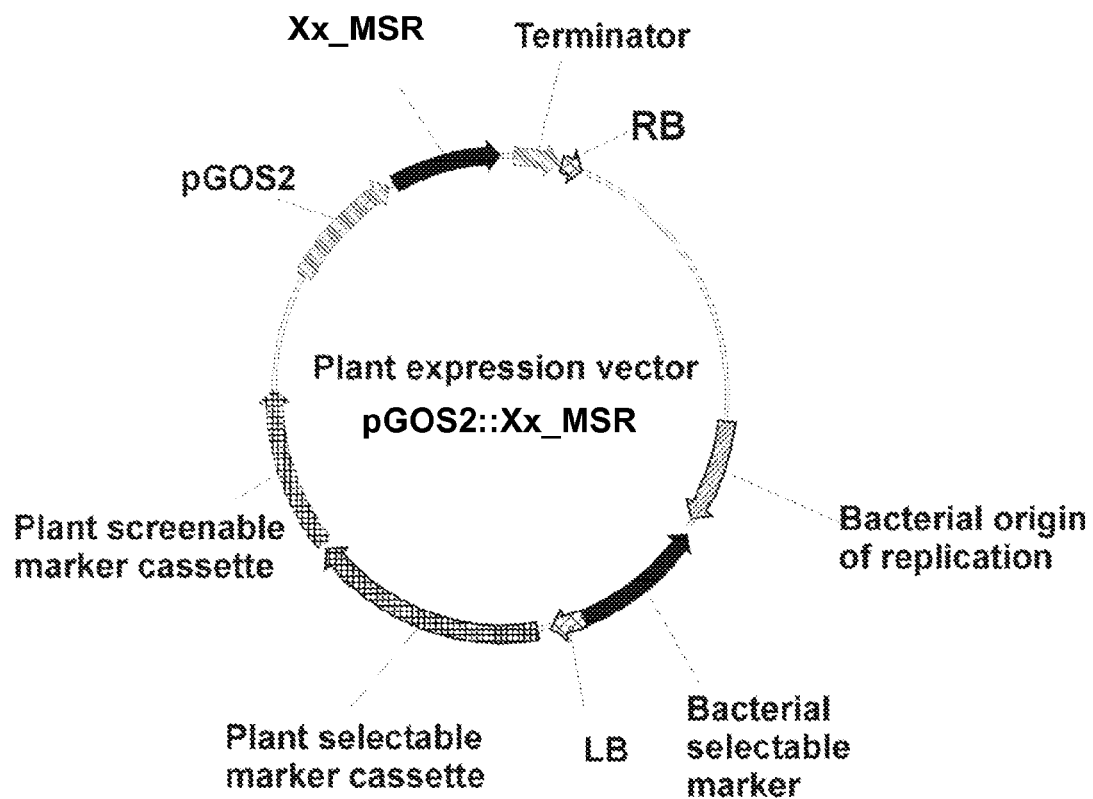
FIG. 2 represents the binary vector for increased expression in *Oryza sativa* of a MSR-encoding nucleic acid under the control of a rice GOS2 promoter (pGOS2)

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Identification of Sequences Related to the Nucleic Acid Sequence Used in the Methods of the Invention Sequences (full length cDNA, ESTs or genomic) related to the nucleic acid sequence used in the methods of the present invention were identified amongst those maintained in the Entrez Nucleotides database at the National Center for Biotechnology Information (NCBI) and other databases using database sequence search tools, such as the Basic Local Alignment Tool (BLAST) (Altschul et al. (1990) J. Mol. Biol.

215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid used in the present invention was used for the TBLASTN algorithm, with default settings and without the filter for low complexity sequences. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length.

1.1. Methionine Sulfoxide Reductase (Msr)

Table A1 provides a list of nucleic acid sequences and encoded proteins thereof related to the nucleic acid sequence used in the methods of the present invention.

TABLE A1

Examples of MSR nucleic acids and polypeptides:

| Name | Nucleic acid SEQ ID NO: | Polypeptide SEQ ID NO: |
|---|---|---|
| OS_MSR | 1 | 2 |
| AT1G53670.1 | 3 | 4 |
| AT2G18030.1 | 5 | 6 |
| AT4G04800.1 | 7 | 8 |
| AT4G04810.1 | 9 | 10 |
| AT4G04830.1 | 11 | 12 |
| AT4G04840.1 | 13 | 14 |
| AT4G21830.1 | 15 | 16 |
| AT4G21840.1 | 17 | 18 |
| AT4G21850.1 | 19 | 20 |
| AT4G21860.1 | 21 | 22 |
| AT4G25130.1 | 23 | 24 |
| AT5G07460.1 | 25 | 26 |
| AT5G07470.1 | 27 | 28 |
| AT5G61640.1 | 29 | 30 |
| Gm_Hyseq_1 | 31 | 32 |
| Gm_Hyseq_2 | 33 | 34 |
| Hv_BI953981 | 35 | 36 |
| Hv_CD054996 | 37 | 38 |
| Hv_TA34992_4513 | 39 | 40 |
| Lu_Hyseq_Linseed | 41 | 42 |
| Mt_TA23181_3880 | 43 | 44 |
| Mt_TA27592_3880 | 45 | 46 |
| Os03g0360700 | 47 | 48 |
| Os04g0482000 | 49 | 50 |
| Os05g0404200 | 51 | 52 |
| Os06g0138100 | 53 | 54 |
| Os06g0472000 | 55 | 56 |
| Os10g0563600 | 57 | 58 |
| Ot_29409 | 59 | 60 |
| Ot_36412_1400010063 | 61 | 62 |
| Pp_TA15842_3218 | 63 | 64 |
| Pp_TA19162_3218 | 65 | 66 |
| Pp_TA19978_3218 | 67 | 68 |
| Pp_TA27864_3218 | 69 | 70 |
| Pp_TA27941_3218 | 71 | 72 |
| Pt_scaff_13972.1#1 | 73 | 74 |
| Pt_scaff_15051.1#1 | 75 | 76 |
| Pt_scaff_20878.2#1 | 77 | 78 |
| Pt_scaff_232.6#1 | 79 | 80 |
| Pt_scaff_VII.1214#1 | 81 | 82 |
| Pt_scaff_VIII.1881#1 | 83 | 84 |
| Pt_scaff_XI.858#1 | 85 | 86 |
| Pt_scaff_XII.839#1 | 87 | 88 |
| Pt_scaff_XV.665 | 89 | 90 |
| Pt_scaff_XV.916#1 | 91 | 92 |
| Ta_CD879384 | 93 | 94 |

TABLE A1-continued

Examples of MSR nucleic acids and polypeptides:

| Name | Nucleic acid SEQ ID NO: | Polypeptide SEQ ID NO: |
|---|---|---|
| Ta_CV781803 | 95 | 96 |
| Ta_TA50939_4565 | 97 | 98 |
| Zm\TA195613_4577 | 99 | 100 |
| Mt_pilin | 101 | 102 |
| AT4G21850.2#1 | 103 | 104 |
| AT4G21860.2#1 | 105 | 106 |
| BN06MC01167_41893809@1164#1 | 107 | 108 |
| BN06MC07870_42642598@7850#1 | 109 | 110 |
| BN06MC22817_48769979@22736#1 | 111 | 112 |
| BN06MC29626_51364980@29502#1 | 113 | 114 |
| BN06MC33493_51487934@33340#1 | 115 | 116 |
| GM06MC03057_49779101@3032#1 | 117 | 118 |
| GM06MC07468_50798375@7402#1 | 119 | 120 |
| GM06MC28560_sc16h05@27910#1 | 121 | 122 |
| GM06MC34053_sn39h09@33265#1 | 123 | 124 |
| GM06MSsr78c11.f_46805437@69254#1 | 125 | 126 |
| CV062108#1 | 127 | 128 |
| TA38065_4513#1 | 129 | 130 |
| TA19984_3880#1 | 131 | 132 |
| TA27217_3880#1 | 133 | 134 |
| TA16015_3218#1 | 135 | 136 |
| TA19653_3218#1 | 137 | 138 |
| TA25821_3218#1 | 139 | 140 |
| CD002141#1 | 141 | 142 |
| DB702640#1 | 143 | 144 |
| TA38052_4081#1 | 145 | 146 |
| TA39048_4081#1 | 147 | 148 |
| TA39049_4081#1 | 149 | 150 |
| TA51472_4081#1 | 151 | 152 |
| BQ483809#1 | 153 | 154 |
| CJ539550#1 | 155 | 156 |
| CV772165#1 | 157 | 158 |
| TA81419_4565#1 | 159 | 160 |
| TA81420_4565#1 | 161 | 162 |
| TA83397_4565#1 | 163 | 164 |
| ZM07MC14597_60377151@14563#1 | 165 | 166 |
| ZM07MC28955_BFb0044H16@28867#1 | 167 | 168 |
| ZM07MC36516_57850824@36391#1 | 169 | 170 |
| ZM07MSbpsHQ_68592530.r01@47392#1 | 171 | 172 |

1.2. Enolase (2-phospho-D-glycerate hydrolase)

Table A2 provides a list of nucleic acid sequences and encoded polypeptides thereof related to the Enolase nucleic acid

TABLE A2

Examples of ENOLASE nucleic acids and polypeptides:

| Name | Nucleic acid SEQ ID NO: | Polypeptide SEQ ID NO: |
|---|---|---|
| Enolase | 193 | 194 |
| Os\LOC_Os03g14450.1 | 195 | 196 |
| Os\LOC_Os03g14450.2 | 197 | 198 |
| Os\LOC_Os03g15950.1 | 199 | 200 |
| Os\LOC_Os06g04510.1 | 201 | 202 |
| Os\LOC_Os09g20820.1 | 203 | 204 |
| Os\LOC_Os10g08550 | 205 | 206 |
| Zm\Enolase_1 | 207 | 208 |
| Zm\Enolase_3 | 209 | 210 |
| Zm_Enolase_2 | 211 | 212 |
| Hv\Enolase | 213 | 214 |
| Gm\Enolase\Hyseq | 215 | 216 |
| Gm\Enolase\Hyseq_2 | 217 | 218 |
| AT1G74030 | 219 | 220 |
| AT2G29560 | 221 | 222 |
| AT2G36530.1 | 223 | 224 |
| Pt\scaff_28.296 | 225 | 226 |
| Pt\scaff_IX.1243 | 227 | 228 |

TABLE A2-continued

Examples of ENOLASE nucleic acids and polypeptides:

| Name | Nucleic acid SEQ ID NO: | Polypeptide SEQ ID NO: |
|---|---|---|
| Pt\scaff_XII.488 | 229 | 230 |
| Pt\scaff_XV.1093 | 231 | 232 |
| Ot\Enolase | 233 | 234 |

1.3. Zn Transporter of *Arabidopsis thaliana* (ZAT)

Table A3 provides a list of nucleic acid sequences related to SEQ ID NO: 247.

TABLE A3

Examples of ZAT-like zinc transporter nucleic acids and polypeptides:

| Name | Plant source | Nucleic acid SEQ ID NO | Polypeptide SEQ ID NO: |
|---|---|---|---|
| AT3G58810 | Arabidopsis thaliana | 250 | 251 |
| AT3G61940 | Arabidopsis thaliana | 252 | 253 |
| TA2425 | Carthamus tinctorius | 254 | 255 |
| AF197329 | Eucalyptus grandis | 256 | 257 |
| TA6615 | Ipomoea nil | 258 | 259 |
| TA8245 | Nicotiana benthamiana | 260 | 261 |
| TA14631 | Nicotiana tabacum | 262 | 263 |
| I910 | Populus trichocarpa | 264 | 265 |
| II672 | Populus trichocarpa | 266 | 267 |
| XI272 | Populus trichocarpa | 268 | 269 |
| XIV.515 | Populus trichocarpa | 270 | 271 |
| Os05g03780 | Oryza sativa | 272 | 273 |
| TA62 | Thlaspi caerulescens | 274 | 275 |
| TA176521 | Zea mays | 276 | 277 |

In some instances, sequences were tentatively assembled and publicly disclosed by research institutions, such as The Institute for Genomic Research (TIGR). The Eukaryotic Gene Orthologs (EGO) database was used to identify such sequences by performing a keyword search or by using the BLAST algorithm with the nucleic acid or polypeptide sequence of interest.

1.4. 6-Phosphogluconate Dehydrogenase (6-PGDH)

Table A4 provides a list of nucleic acids and polypeptides (homologous to SEQ ID NO: 282) useful in the invention.

TABLE A4

Examples 6-PGDH nucleic acids and polypeptides:

| Name | Nucleic acid SEQ ID NO: | Polypeptide SEQ ID NO: |
|---|---|---|
| A. formosa_TA10107_338618 | 287 | 288 |
| A. formosa_TA10178_338618 | 289 | 290 |
| A. formosa_TA11596_338618 | 291 | 292 |
| A. thaliana_AT1G64190.1 | 293 | 294 |
| A. thaliana_AT3G02360.1 | 295 | 296 |
| A. thaliana_AT5G41670.1 | 297 | 298 |
| B. distachyon_TA154_15368 | 299 | 300 |
| C. elegans_NM_069597 | 301 | 302 |
| C. reinhardtii_192597 | 303 | 304 |
| C. sinensis_TA13778_2711 | 305 | 306 |
| D. melanogatser_NM_057512 | 307 | 308 |
| D. rerio_AY391449 | 309 | 310 |
| E. coli_AF176373 | 311 | 312 |
| E. gracilis_AB425328 | 313 | 314 |
| G. max_TA45618_3847 | 315 | 316 |
| G. raimondii_TA9789_29730 | 317 | 318 |
| H. vulgare_TA28670_4513 | 319 | 320 |
| L. digitata_AJ130772 | 321 | 322 |
| M. domestica_TA26246_3750 | 323 | 324 |
| M. sativa_U18239 | 325 | 326 |
| M. truncatula_TA20191_3880 | 327 | 328 |

TABLE A4-continued

Examples 6-PGDH nucleic acids and polypeptides:

| Name | Nucleic acid SEQ ID NO: | Polypeptide SEQ ID NO: |
|---|---|---|
| N. punctiforme_CP001037 | 329 | 330 |
| N. tabacum_TA13708_4097 | 331 | 332 |
| O. basilicum_TA383_39350 | 333 | 334 |
| O. lucimarinus_32825 | 335 | 336 |
| O. sativa_Os06g0111500 | 337 | 338 |
| O. sativa_Os11g0484500 | 339 | 340 |
| P. patens_109688 | 341 | 342 |
| P. patens_183544 | 343 | 344 |
| P. persica_TA3702_3760 | 345 | 346 |
| P. taeda_TA3907_3352 | 347 | 348 |
| P. taeda_TA3914_3352 | 349 | 350 |
| P. taeda_TA6813_3352 | 351 | 352 |
| P. trichocarpa_640402 | 353 | 354 |
| P. trichocarpa_656743 | 355 | 356 |
| P. trichocarpa_799988 | 357 | 358 |
| P. trichocarpa_TA13860_3694 | 359 | 360 |
| P. tricornutum_13356 | 361 | 362 |
| P. tricornutum_26934 | 363 | 364 |
| P. vulgaris_TA3361_3885 | 365 | 366 |
| S. bicolor_TA22020_4558 | 367 | 368 |
| S. cerevisiae_YGR256W | 369 | 370 |
| S. lycopersicum_TA40141_4081 | 371 | 372 |
| S. oleracea_chloro | 373 | 374 |
| S. oleracea_cyto | 375 | 376 |
| S. tuberosum_TA30318_4113 | 377 | 378 |
| T. pseudonana_33343 | 379 | 380 |
| V. carteri_109207 | 381 | 382 |
| V. vinifera_TA38655_29760 | 383 | 384 |
| Z. mays_TA9675_4577999 | 385 | 386 |

Example 2

Alignment of Sequences Related to the Polypeptide Sequences Used in the Methods of the Invention 2.1. Methionine Sulfoxide Reductase (Msr)

alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0,1 and the selected weight matrix is Blosum 62 (if polypeptides are aligned). The MSR polypeptides are aligned in FIG. 1. The position of motifs 1 to 4 is indicated on the consensus sequence (MSRA type). The position of motifs 5 to 11 is indicated on the *Medicago truncatula* sequence PF61417__102__*Medicago* (MSRB type).

2.2. Enolase (2-phospho-D-glycerate hydrolase)

Figure 4:
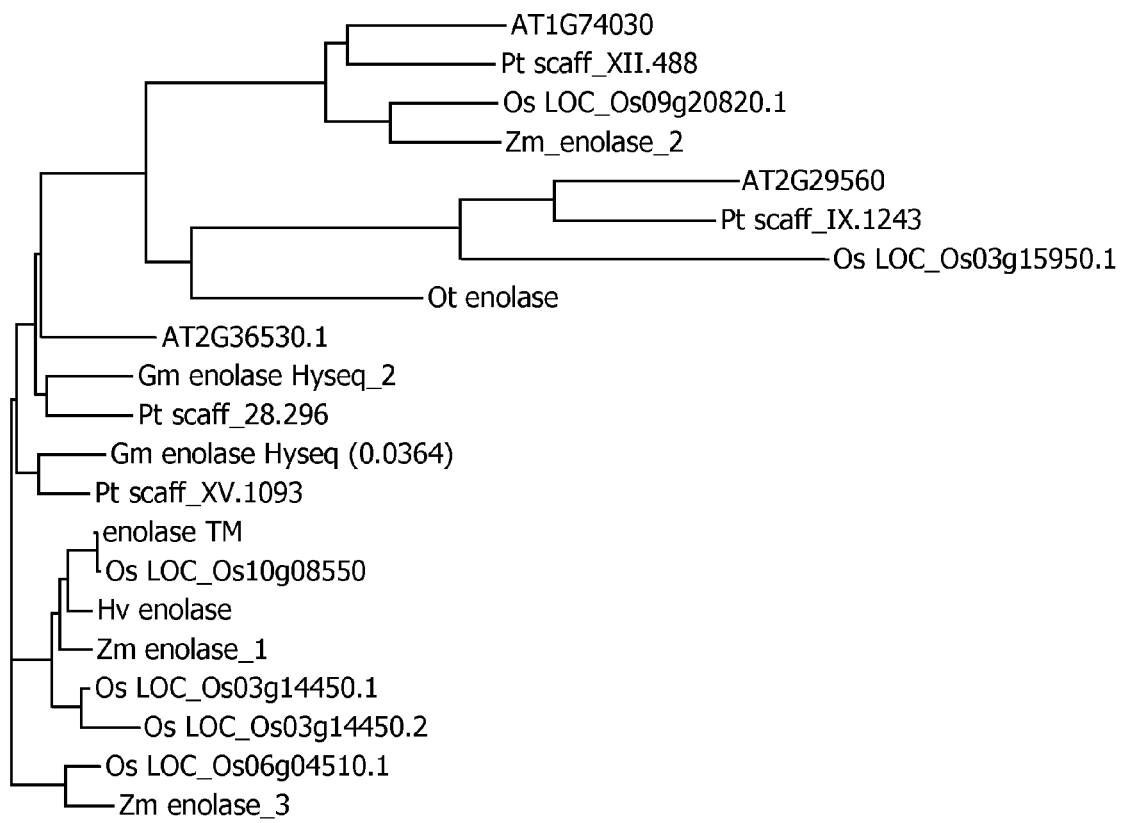
FIG. 4 shows a phylogenetic tree of the Enolase polypeptides of Table A2.

Alignment of polypeptide sequences was performed using the AlignX programme from the Vector NTI (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values were for the gap open penalty of 10, for the gap extension penalty of 0,1 and the selected weight matrix was Blosum 62 (if polypeptides were aligned). Sequence conservation among ENOLASE polypeptides is essentially conseved along the Enolase domain. The consensus sequences shows highly conserved amino acid amongst ENOLASE polypeptides. In the consensus sequence, empty spaces between amino acid represent any amino acid. The ENOLASE polypeptides are aligned in FIG. 4.

A phylogenetic tree of ENOLASE polypeptides (FIG. 4) was constructed using a neighbour-joining clustering algorithm as provided in the AlignX programme from the Vector NTI (Invitrogen).

2.3. Zn Transporter of *Arabidopsis thaliana* (ZAT)

Figure 7:
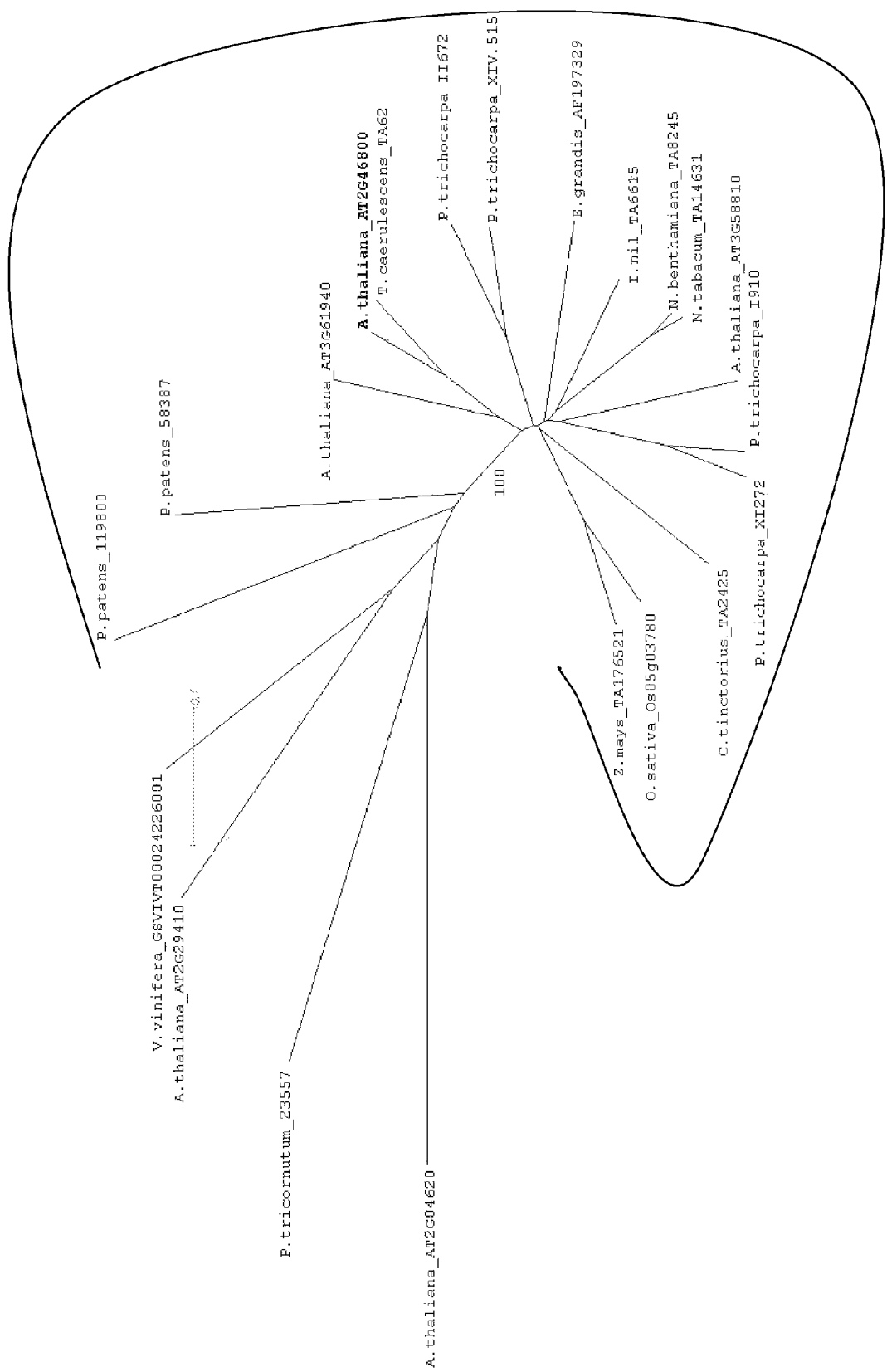
FIG. 7 shows a circular phylogenetic tree of various ZAT-like zinc transporter polypeptides and related sequences. The polypeptide sequences were aligned using MUSCLE and the alignment is shown in FIG. 6. A Neighbour-Joining tree was calculated using CLUSTALW. Thompson et al. (1997) Nucleic Acids Res 25:4876-4882; Chenna et al. (2003). Nucleic Acids Res 31:3497-3500. Support for the major branching is indicated for 100 bootstrap repetitions. The circular phylogram was drawn using Dendroscope. The ZAT-like zinc transporter polypeptide of SEQ ID NO: 249 is indicated in bold. Other ZAT-like zinc transporter polypeptide sequences are those within the bracket. Examples of ZAT-like zinc transporter polypeptides useful in the methods of the present invention are those indicated within the bracket.

The alignment of ZAT-like zinc transporter polypeptides and other sequences was performed as described in FIGS. 6 and 7 herein. A phylogenetic tree of ZAT polypeptides (FIG. 7) was also constructed as described.

2.4. 6-Phosphogluconate Dehydrogenase (6-PGDH)

Alignment of polypeptide sequences is performed using the AlignX programme from the Vector NTI package (Invitrogen) which is based on the popular Clustal W algorithm of progressive alignment (Thompson et al. (1997) Nucleic Acids Res 25:4876-4882; Chenna et al. (2003). Nucleic Acids Res 31:3497-3500). Default values are for the gap open penalty of 10, for the gap extension penalty of 0,1 and the selected weight matrix is Blosum 62 (if polypeptides are aligned). Minor manual editing may be done to further optimise the alignment.

Figure 9:
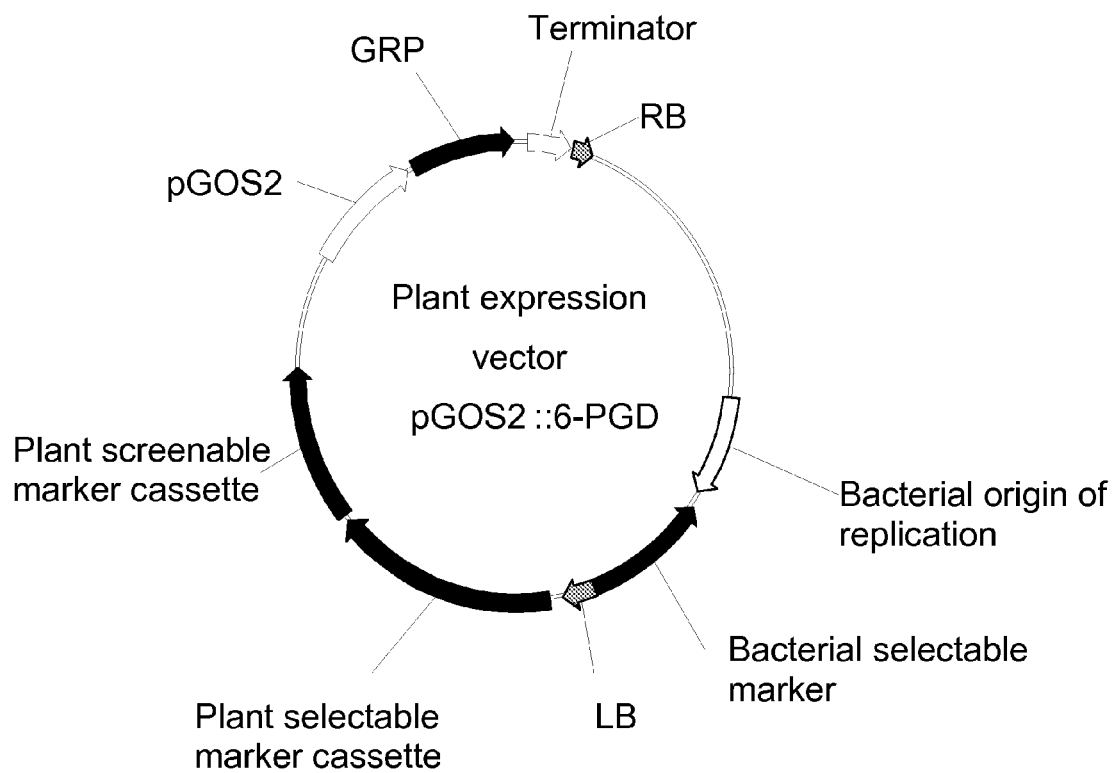
FIG. 9 represents the binary vector for increased expression in *Oryza sativa* of a 6-PGDH-encoding nucleic acid under the control of a rice GOS2 promoter (pGOS2::6-PGDH).

FIG. 9 shows the alignment of 6-PGDH polypeptide sequences useful in the methods of the invention.

Example 3

Calculation of Global Percentage Identity Between Polypeptide Sequences Useful in Performing the Methods of the Invention 3.1. Methionine Sulfoxide Reductase (Msr)

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:

Scoring matrix: Blosum62

First Gap: 12

Extending gap: 2

Results of the software analysis are shown in Table B1 for the global similarity and identity over the full length of the polypeptide sequences. Percentage identity is given above the diagonal and percentage similarity is given below the diagonal.

The percentage identity between the MSR polypeptide sequences useful in performing the methods of the invention can be as low as 13.3% amino acid identity compared to SEQ ID NO: 2 or 12.6% to SEQ ID NO: 102.

TABLE B1

MatGAT results for global similarity and identity over the full length of the polypeptide sequences.

| | 1 | 2 | 3 | 4 | 5 | 6 | 7 | 8 | 9 | 10 | 11 |
|---|---|---|---|---|---|---|---|---|---|---|---|
| 1. AT1G53670.1 | | 14.5 | 9.8 | 11.6 | 19.6 | 16.7 | 12 | 14.9 | 13.1 | 19.8 | 16.2 |
| 2. AT2G18030.1 | 29.1 | | 26.7 | 28.1 | 25 | 24.5 | 31.4 | 27.9 | 30.1 | 26.5 | 25.2 |
| 3. CDSXXXX | 25.9 | 39 | | 66.8 | 58.5 | 34.9 | 74.1 | 72.7 | 59.9 | 77.9 | 32.6 |
| 4. Gm_Hyseq_1 | 26.2 | 43.7 | 76 | | 59.9 | 35.1 | 69.4 | 70.6 | 57.1 | 54.6 | 29.9 |
| 5. Gm_Hyseq_2 | 32.1 | 44.2 | 66.8 | 70.2 | | 28.6 | 61.4 | 66 | 51.3 | 61 | 26.8 |
| 6. Hv_CD054996 | 26.2 | 38.6 | 49.8 | 49.8 | 41.1 | | 36.1 | 36.4 | 37.9 | 27.3 | 24.2 |
| 7. Lu_Hyseq_Linseed | 27.5 | 42.5 | 84.4 | 76.9 | 69.8 | 56.4 | | 77 | 63.1 | 57.8 | 32.6 |
| 8. Mt_TA23181_3880 | 28.7 | 39.4 | 83.4 | 81.4 | 72.5 | 56.4 | 87.3 | | 62.3 | 56.7 | 31.4 |
| 9. Mt_TA27592_3880 | 29.7 | 41.3 | 68.8 | 66.1 | 56.6 | 56.6 | 74 | 73.3 | | 47.5 | 28.8 |
| 10. Os10g0563600 | 29.7 | 41.1 | 77.9 | 65.8 | 74.3 | 38.8 | 65.8 | 65 | 54.4 | | 27.9 |
| 11. Ot_36412_1400010063 | 30.7 | 39.3 | 40.5 | 41.2 | 44.2 | 38.1 | 43.2 | 42.8 | 38.9 | 41.1 | |
| 12. Pp_TA15842_3218 | 28.2 | 39 | 61.5 | 60.6 | 49.8 | 58.5 | 61.8 | 65.3 | 61.7 | 47.5 | 38.5 |
| 13. Ta_CV781803 | 29.8 | 38.2 | 63.3 | 64.7 | 54 | 49.1 | 62.8 | 63.8 | 61.5 | 52.9 | 42 |
| 14. Zm\TA195613_4577 | 30.7 | 73.6 | 40.6 | 44.7 | 40.8 | 40.2 | 40.6 | 41.4 | 41 | 40.3 | 40.9 |
| 15. B. napus_BN06MC22817 | 50.2 | 33.5 | 30.8 | 29.9 | 29.8 | 28.4 | 28 | 29.4 | 24.6 | 23.2 | 29.2 |
| 16. G. max_GM06MC34053 | 76.7 | 28.7 | 26.3 | 29.4 | 27.2 | 24.8 | 29.9 | 30.2 | 30.7 | 29.3 | 25.3 |
| 17. M. truncatula_TA19984_3880#1 | 51 | 29.5 | 28.8 | 29.4 | 27.2 | 30.2 | 34.3 | 35.6 | 26.5 | 24.3 | 27.6 |
| 19. P. patens_TA25821_3218#1 | 41.6 | 21.7 | 23.4 | 27.1 | 21.5 | 26.8 | 25 | 23.8 | 21.9 | 20.5 | 24.1 |
| 20. S. lycopersicum_DB702640#1 | 65.8 | 26.8 | 28.3 | 23.5 | 24.2 | 26.2 | 24 | 23.8 | 28.1 | 22.4 | 21.8 |
| 21. T. aestivum_BQ483809#1 | 47.9 | 26.4 | 29.8 | 32.6 | 24.9 | 29.3 | 32.6 | 33 | 26.5 | 25.5 | 31.5 |
| 18. M. truncatula_TA27217_3880#1 | 70.3 | 28 | 31.6 | 29.9 | 30.2 | 34.4 | 28.8 | 32.5 | 32.1 | 28.9 | 23.7 |

| | 12 | 13 | 14 | 15 | 16 | 17 | 18 | 19 | 20 | 21 |
|---|---|---|---|---|---|---|---|---|---|---|
| 1. AT1G53670.1 | 14.4 | 15.9 | 17.6 | 37.4 | 58.9 | 34.8 | 56.5 | 29.9 | 56.9 | 33 |
| 2. AT2G18030.1 | 28.3 | 27.1 | 61.3 | 17.6 | 16.4 | 16.1 | 13.7 | 13.3 | 13.3 | 16.3 |
| 3. CDSXXXX | 51.7 | 50.4 | 29.3 | 14.3 | 11.6 | 15.6 | 12.8 | 14.8 | 16.6 | 16.4 |
| 4. Gm_Hyseq_1 | 49.8 | 49.8 | 30.8 | 14.4 | 11.8 | 15 | 12.2 | 15.4 | 12.6 | 15.8 |
| 5. Gm_Hyseq_2 | 42.3 | 37.9 | 24.7 | 20.3 | 14.3 | 17.1 | 16.6 | 12.4 | 15.5 | 16.6 |
| 6. Hv_CD054996 | 43.8 | 34.2 | 27.1 | 13.3 | 13.9 | 14.9 | 18.1 | 15.7 | 17.6 | 16.1 |
| 7. Lu_Hyseq_Linseed | 53.9 | 47 | 29 | 15.2 | 12.3 | 19.4 | 12.3 | 10.6 | 14.7 | 17 |
| 8. Mt_TA23181_3880 | 55.9 | 46.8 | 28.6 | 16.4 | 17.4 | 19.2 | 14.6 | 15.5 | 15.8 | 17.2 |
| 9. Mt_TA27592_3880 | 53.1 | 50 | 28.6 | 13.7 | 12.3 | 14.8 | 11 | 15.3 | 14.7 | 14.1 |
| 10. Os10g0563600 | 40.3 | 40.9 | 26.8 | 17.9 | 16.2 | 13.1 | 15 | 13.3 | 13.7 | 13.7 |
| 11. Ot_36412_1400010063 | 28 | 31.1 | 26.2 | 15.8 | 12.7 | 17.1 | 12.4 | 16.3 | 14.4 | 19.4 |

TABLE B1-continued

MatGAT results for global similarity and identity over the full length of the polypeptide sequences.

| | | | | | | | | | | | |
|---|---|---|---|---|---|---|---|---|---|---|---|
| 12. Pp__TA15842__3218 | | 43.6 | 27.4 | 12.6 | 13.6 | 12.8 | 12.7 | 16.8 | 14.3 | 12.1 | |
| 13. Ta__CV781803 | 56.9 | | 29.4 | 14 | 13.7 | 12.6 | 16.5 | 14.5 | 14.5 | 15.9 | |
| 14. Zm\TA195613__4577 | 40.2 | 41 | | 15.3 | 20.6 | 16.1 | 17.5 | 13.5 | 15.5 | 14.1 | |
| 15. B. napus__BN06MC22817 | 28 | 26.6 | 30.7 | | 33.3 | 59.7 | 33.2 | 53.6 | 31.3 | 57.8 | |
| 16. G. max__GM06MC34053 | 32.2 | 24.3 | 33.2 | 46.9 | | 32.2 | 71.5 | 30.1 | 62.4 | 35.7 | |
| 17. M. truncatula__TA19984__3880#1 | 29.1 | 25.7 | 29.1 | 72 | 49 | | 33 | 54.2 | 34.4 | 60.9 | |
| 19. P. patens__TA25821__3218#1 | 27.4 | 23.4 | 21.3 | 57.8 | 41.6 | 63.5 | 40.1 | | 41.8 | 46.5 | |
| 20. S. lycopersicum__DB702640#1 | 29.2 | 27.5 | 28.3 | 42.7 | 67.8 | 48.1 | 65.1 | 56.8 | | 31.7 | |
| 21. T. aestivum__BQ483809#1 | 23.7 | 23.4 | 28.3 | 70.2 | 47.9 | 72.6 | 48.8 | 55.3 | 41.4 | | |
| 18. M. truncatula__TA27217__3880#1 | 31.1 | 28.4 | 31.6 | 50.9 | 82.1 | 48.6 | | 28.7 | 58.5 | 35.6 | |

3.2. Enolase (2-phospho-D-glycerate hydrolase)

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

Results of the software analysis are shown in Table B2 for the global similarity and identity over the full length of the polypeptide sequences. Percentage identity is given above the diagonal and percentage similarity is given below the diagonal.

The percentage identity between the ENOLASE polypeptide sequences of Table A2 can be as low as 45.9% amino acid identity compared to SEQ ID NO: 194.

TABLE B2

MatGAT results for global similarity and identity over the full length of the polypeptide sequences.

| | 1 | 2 | 3 | 4 | 5 | 6 | 7 | 8 | 9 | 10 | 11 |
|---|---|---|---|---|---|---|---|---|---|---|---|
| 1. Enolase\TM | | 92.9 | 87.4 | 60.9 | 51.5 | 89.0 | 90.1 | 97.1 | 89.5 | 53.5 | 96.0 |
| 2. Os_LOC_Os 10g08550 | 92.9 | | 81.3 | 62.5 | 52.1 | 82.7 | 83.8 | 90.2 | 83.1 | 56.1 | 89.2 |
| 3. AT2G36530__1 | 93.7 | 87.1 | | 60.8 | 52.3 | 88.3 | 86.5 | 88.6 | 86.3 | 53.4 | 88.6 |
| 4. AT1G74030 | 75.5 | 77.3 | 74.4 | | 51.7 | 61.4 | 61.7 | 60.6 | 61.7 | 70.0 | 60.6 |
| 5. AT2G29560 | 68.2 | 69.2 | 68.4 | 70.4 | | 51.4 | 52.4 | 51.1 | 50.8 | 44.7 | 51.3 |
| 6. Gm_Enolase_Hyseq_2 | 94.6 | 87.9 | 93.7 | 74.6 | 68.0 | | 89.0 | 88.6 | 87.4 | 54.1 | 88.3 |
| 7. Gm_Enolase_Hyseq | 96.4 | 89.6 | 93.0 | 76.1 | 68.6 | 95.7 | | 90.1 | 89.2 | 53.3 | 89.7 |
| 8. Hv_Enolase | 98.2 | 91.3 | 93.7 | 75.1 | 67.8 | 93.7 | 96.2 | | 89.7 | 53.3 | 96.6 |
| 9. Zm_Enolase_1 | 94.8 | 88.1 | 91.7 | 75.5 | 67.6 | 91.9 | 94.2 | 94.2 | | 53.5 | 89.5 |
| 10. Zm_Enolase_2 | 63.8 | 67.4 | 63.3 | 78.4 | 61.3 | 62.9 | 64.0 | 63.5 | 63.1 | | 53.3 |
| 11. Zm_Enolase_1 | 98.2 | 91.3 | 93.7 | 75.1 | 67.6 | 94.6 | 95.7 | 98.7 | 95.1 | 63.8 | |
| 12. Ot_Enolase | 75.9 | 78.2 | 76.3 | 75.9 | 75.7 | 77.2 | 77.0 | 75.5 | 75.7 | 66.7 | 75.7 |
| 13. Pt_scaff_IX_1243 | 22.0 | 23.1 | 21.6 | 22.9 | 33.1 | 21.2 | 22.0 | 22.0 | 21.1 | 21.4 | 22.0 |
| 14. Pt_scaff_28_296 | 88.8 | 87.5 | 88.1 | 74.4 | 68.8 | 89.6 | 89.2 | 87.7 | 86.9 | 62.8 | 88.3 |
| 15. Pt_scaff_XII_488 | 71.9 | 74.5 | 71.7 | 89.9 | 67.6 | 70.9 | 72.5 | 71.5 | 71.7 | 78.6 | 71.9 |
| 16. Pt_scaff_XV_1093 | 95.5 | 88.8 | 93.0 | 74.8 | 67.6 | 94.6 | 98.0 | 95.1 | 95.1 | 63.1 | 95.5 |
| 17. Os_LOC_Os09g20820_1 | 75.2 | 78.1 | 73.5 | 87.7 | 68.5 | 73.9 | 75.4 | 74.9 | 73.9 | 79.9 | 74.9 |
| 18. Os_LOC_Os03g14450_2 | 85.4 | 79.4 | 83.3 | 66.2 | 59.2 | 82.4 | 84.3 | 85.2 | 83.0 | 55.9 | 86.1 |
| 19. Os_LOC_Os03g14450_1 | 97.8 | 90.8 | 94.2 | 74.8 | 67.4 | 94.6 | 96.0 | 97.8 | 94.8 | 63.8 | 98.4 |
| 20. Os_LOC_Os03g15950_1 | 63.0 | 65.2 | 65.1 | 67.6 | 81.6 | 64.2 | 64.2 | 63.0 | 62.6 | 59.0 | 62.6 |
| 21. Os_LOC_Os06g04510_1 | 95.1 | 88.3 | 91.7 | 75.3 | 66.9 | 92.4 | 94.8 | 94.8 | 98.2 | 63.5 | 95.5 |

| | 12 | 13 | 14 | 15 | 16 | 17 | 18 | 19 | 20 | 21 |
|---|---|---|---|---|---|---|---|---|---|---|
| 1. Enolase\TM | 65.9 | 15.3 | 83.5 | 59.6 | 91.0 | 61.7 | 82.1 | 95.1 | 45.9 | 89.9 |
| 2. Os_LOC_Os 10g08550 | 66.3 | 17.0 | 77.9 | 60.6 | 84.6 | 63.0 | 76.5 | 88.3 | 47.0 | 83.5 |
| 3. AT2G36530__1 | 66.0 | 16.0 | 82.6 | 59.5 | 88.8 | 60.6 | 76.6 | 87.9 | 47.2 | 86.3 |
| 4. AT1G74030 | 61.1 | 15.8 | 58.4 | 80.3 | 61.7 | 79.4 | 52.4 | 60.4 | 46.9 | 61.9 |
| 5. AT2G29560 | 58.3 | 31.2 | 49.7 | 49.5 | 52.1 | 50.7 | 43.9 | 51.0 | 63.8 | 51.3 |
| 6. Gm_Enolase_Hyseq_2 | 66.2 | 16.0 | 85.4 | 60.5 | 88.3 | 62.8 | 76.8 | 89.2 | 46.2 | 88.6 |

TABLE B2-continued

MatGAT results for global similarity and identity over the full length of the polypeptide sequences.

| | | | | | | | | | | |
|---|---|---|---|---|---|---|---|---|---|---|
| 7. Gm_Enolase_Hyseq | 65.3 | 16.0 | 84.1 | 59.8 | 93.5 | 62.1 | 78.2 | 89.7 | 46.8 | 90.1 |
| 8. Hv_Enolase | 65.5 | 15.3 | 82.7 | 59.4 | 91.7 | 61.5 | 82.1 | 95.3 | 45.5 | 90.6 |
| 9. Zm_Enolase_1 | 66.3 | 15.3 | 82.7 | 60.4 | 90.4 | 62.3 | 78.5 | 90.1 | 45.9 | 95.5 |
| 10. Zm_Enolase_2 | 54.0 | 15.5 | 51.3 | 70.8 | 53.0 | 76.0 | 46.0 | 53.4 | 42.3 | 54.2 |
| 11. Zm_Enolase_1 | 64.4 | 15.7 | 83.5 | 59.4 | 91.3 | 61.5 | 82.7 | 95.7 | 45.9 | 90.8 |
| 12. Ot_Enolase | | 20.9 | 63.0 | 57.8 | 65.9 | 62.0 | 58.4 | 65.6 | 53.0 | 65.7 |
| 13. Pt_scaff_IX_1243 | 27.0 | | 14.6 | 15.4 | 15.5 | 16.1 | 13.5 | 15.6 | 23.0 | 15.7 |
| 14. Pt_scaff_28_296 | 77.2 | 19.7 | | 57.3 | 84.6 | 58.8 | 72.5 | 83.3 | 44.3 | 83.1 |
| 15. Pt_scaff_XII_488 | 73.5 | 22.3 | 71.3 | | 59.6 | 78.5 | 51.0 | 59.5 | 45.5 | 60.8 |
| 16. Pt_scaff_XV_1093 | 76.5 | 21.3 | 90.0 | 71.9 | | 60.9 | 79.8 | 91.3 | 45.5 | 91.3 |
| 17. Os_LOC_Os09g20820_1 | 75.5 | 21.1 | 73.3 | 86.2 | 73.9 | | 52.8 | 61.8 | 47.6 | 62.3 |
| 18. Os_LOC_Os03g14450_2 | 68.1 | 23.4 | 77.8 | 62.8 | 83.8 | 64.7 | | 86.3 | 41.9 | 78.7 |
| 19. Os_LOC_Os03g14450_1 | 75.9 | 21.3 | 88.3 | 71.7 | 95.7 | 74.7 | 87.2 | | 45.3 | 91.0 |
| 20. Os_LOC_Os03g15950_1 | 72.8 | 27.2 | 63.8 | 65.4 | 63.0 | 67.0 | 56.9 | 62.1 | | 46.2 |
| 21. Os_LOC_Os06g04510_1 | 75.5 | 20.6 | 87.3 | 71.3 | 95.7 | 74.3 | 83.2 | 95.3 | 62.3 | |

3. Zn Transporter of *Arabidopsis thaliana* (ZAT)

Calculation of global percentage of similarity and identity between full length polypeptide sequences is determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix.

Parameters used in the comparison are:
Scoring matrix: Blosum62
First Gap: 12
Extending gap: 2

3.4. 6-Phosphogluconate Dehydrogenase (6-PGDH)

Global percentages of similarity and identity between full length polypeptide sequences useful in performing the methods of the invention are determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison were:
Scoring matrix: Blosum62
First Gap: 12
Extending gap: 2

A MATGAT table for local alignment of a specific domain, or data on % identity/similarity between specific domains may also be generated. Table B4 shows the results on percentage identity of polypeptides useful in the method or the invention calculated with the MATGAT algorithm.

TABLE B4

MatGAT results for global similarity and identity over the full length of the polypeptide sequences.

| | 1 | 2 | 3 | 4 | 5 | 6 | 7 | 8 | 10 | 11 | 12 | 13 | 14 |
|---|---|---|---|---|---|---|---|---|---|---|---|---|---|
| 1. C. reinhardtii_192597 | | 63.4 | 83.4 | 49.2 | 47.4 | 47.7 | 45.9 | 46.3 | 41.4 | 41.8 | 46 | 39.9 | 39.6 |
| 2. O. lucimarinus_32825 | | | 62.7 | 51 | 51.1 | 49.7 | 49.4 | 51.8 | 44.3 | 43.9 | 47 | 41.8 | 42.2 |
| 3. V. carteri_109207 | | | | 49.4 | 48 | 48.6 | 46.8 | 46.8 | 41.5 | 42.7 | 45.5 | 40.2 | 39.9 |
| 4. E. gracilis_AB425328 | | | | | 62.8 | 57.6 | 63.5 | 64.7 | 45.9 | 48.2 | 53.8 | 45.8 | 46.9 |
| 5. L. digitata_AJ130772 | | | | | | 56.4 | 62.5 | 59.4 | 43.6 | 44.2 | 51.3 | 43.6 | 43.6 |
| 6. P. tricornutum_13356 | | | | | | | 61.6 | 62.9 | 44.9 | 44.9 | 47.9 | 41.8 | 44 |
| 7. P. tricornutum_26934 | | | | | | | | 67.7 | 46.3 | 47.3 | 50 | 47.2 | 46.6 |
| 8. T. pseudonana_33343 | | | | | | | | | 44.8 | 46 | 49.2 | 43.1 | 44.9 |
| 10. D. rerio_AY391449 | | | | | | | | | | 49.5 | 50.3 | 70.1 | 64.1 |
| 11. E. coli_AF176373 | | | | | | | | | | | 57 | 49.1 | 47.1 |
| 12. N. punctiforme_CP001037 | | | | | | | | | | | | 50.6 | 48.2 |
| 13. C. elegans_NM_069597 | | | | | | | | | | | | | 62.5 |
| 14. S. cerevisiae_YGR256W | | | | | | | | | | | | | |

Example 4

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

4.1. Methionine Sulfoxide Reductase (Msr)

The results of the InterPro scan of the polypeptide sequence as represented by SEQ ID NO: 2 are presented in Table C1.

TABLE C1

InterPro scan results (major accession numbers) of the polypeptide sequence as represented by SEQ ID NO: 2.

| Database | Accession number | Accession name | Evalue | Amino acid coordinates on SEQ ID NO 2 (start-end) |
|---|---|---|---|---|
| Interpro | IPR002569 | PMSR (Methionine sulphoxide reductase A) | 2.9e−74 | 39-192 |

The results of the InterPro scan of the polypeptide sequence as represented by SEQ ID NO: 102 are presented in Table C2.

TABLE C2

InterPro scan results (major accession numbers) of the polypeptide sequence as represented by SEQ ID NO: 102.

| Interpro accession number | Other database | Accession in other database | Accession name | E value | Amino acid coordinates on SEQ ID NO 102 (start-end) |
|---|---|---|---|---|---|
| IPR011057 | SUPERFAMILY 1.69 | SSF51316 | Mss4-like | 1.50E−54 | 26-154 |
| IPR002579 | TIGRFAMs | TIGR00357 | Methionine sulphoxide reductase B | 3.40E−75 | 28-154 |
| IPR002579 | Pfam 23.0 | PF01641 | Methionine sulphoxide reductase B | 1.10E−75 | 31-153 |
| IPR002579 | ProDom 2005.1 | PD004057 | Methionine sulphoxide reductase B | 4.00E−61 | 31-149 |

4.2. Enolase (2-phospho-D-glycerate hydrolase)

The results of the InterPro scan of the polypeptide sequence as represented by SEQ ID NO: 194 are presented in Table C3.

TABLE C3

InterPro scan results of the polypeptide sequence as represented by SEQ ID NO: 194.

| | | | Enolase | |
|---|---|---|---|---|
| InterPro | Database | Accession number | Accession name | e-value/acid coordinates on SEQ ID NO 194 [Start-End]T |
| IPR000941 Family | PRODOM | PD000902 | Q7XBE4_EEEEE_Q7XBE4; | 5e−163/[154-442]T |
| | PRINTS | PR00148 | ENOLASE | 5.2e−52/[38-52]T |
| | | | | 5.2e−52/[113-129]T |
| | | | | 5.2e−52/[170-183]T |
| | | | | 5.2e−52/[328-339]T |
| | | | | 5.2e−52/[351-365]T |
| | | | | 5.2e−52/[380-397]T |
| | PIR | PIRSF001400 | Enolase | 5.5e−272/[2-442]T |
| | PANTHER | PTHR11902 | ENOLASE | 6e−123/[4-221]T |
| | PFAM | PF00113 | Enolase_C | 1.5e−215/[148-443]T |
| | PFAM | PF03952 | Enolase_N | 3.5e−68/[4-140]T |
| | TIGRFAMs | TIGR01060 | eno: phosphopyruvate hydratase | 3.1e−242/[5-443]T |
| | PROSITE | PS00164 | ENOLASE | 8e−5/[351-364]T |

4.3. Zn Transporter of *Arabidopsis thaliana* (ZAT)

The results of the InterPro scan of the polypeptide sequence as represented by SEQ ID NO: 248 are presented in Table C4.

TABLE C4

InterPro scan results (major accession numbers) of the polypeptide sequence as represented by SEQ ID NO: 249.

| InterPro | IPR002524 | Cation efflux protein | |
|---|---|---|---|
| Biological Process: cation transport (GO: 0006812), Molecular Function: cation transporter activity (GO: 0008324), Cellular Component: membrane (GO: 0016020) | | | |
| method | AccNumber | shortName | location |
| PANTHER | PTHR11562 | CATION EFFLUX PROTEIN/ZINC TRANSPORTER | 1e-106 [33-204]T 1e-106 [251-397]T |
| Pfam | PF01545 | Cation_efflux | 6.4e-73 [58-397]T |
| TigrFAMS | TIGR01297 | CDF: cation diffusion facilitator family tr | 4.3e-85 [54-398]T |

4.4. 6-Phosphogluconate Dehydrogenase (6-PGDH)

The protein sequences representing the 6-PGDH are used as query to search the InterPro database (Table C5).

TABLE C5

| Method | Acc Number | Short Name | location |
|---|---|---|---|
| InterPro | IPR006113 | 6-phosphogluconate dehydrogenase, decarboxylating | |
| HMMTigr | TIGR00873 | gnd: 6-phosphogluconate dehydrogenase, decar | [5-473] |
| InterPro | IPR006114 | 6-phosphogluconate dehydrogenase, C-terminal | |
| HMMPfam | PF00393 | 6PGD | [182-472] |
| InterPro | IPR006115 | 6-phosphogluconate dehydrogenase, NAD-binding | |
| HMMPfam | PF03446 | NAD_binding_2 | [3-178] |
| InterPro | IPR006183 | 6-phosphogluconate dehydrogenase | |
| FPrintScan | PR00076 | 6PGDHDRGNASE | [4-27] [69-98] [122-147] [171-199] [253-280] [361-383] |
| InterPro | IPR008927 | 6-phosphogluconate dehydrogenase, C-terminal-like | |
| superfamily | SSF48179 | 6-phosphogluconate dehydrogenase C-terminal domain-like | [180-477] |
| InterPro | IPR012284 | Fibritin/6-phosphogluconate dehydrogenase, C-terminal extension | |
| Gene3D | G3DSA:1.20.5.320 | no description | [440-471] |
| InterPro | IPR013328 | Dehydrogenase, multihelical | |
| Gene3D | G3DSA:1.10.1040.10 | no description | [184-439] |
| InterPro | IPR016040 | NAD(P)-binding | |
| Gene3D | G3DSA:3.40.50.720 | no description | [2-183] |
| superfamily | SSF51735 | NAD(P)-binding Rossmann-fold domains | [3-179] |
| InterPro | NULL | NULL | |
| HMMPanther | PTHR11811 | 6-PHOSPHOGLUCONATE DEHYDROGENASE | [183-479] |
| SignalPHMM | signalp | signal-peptide | [1-19] |

Example 5

Topology Prediction of the Polypeptide Sequences Useful in Performing the Methods of the Invention TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters were selected, such as organism group (non-plant or plant), cutoff sets (none, predefined set of cutoffs, or user-specified set of cutoffs), and the calculation of prediction of cleavage sites (yes or no).

5.1. Zn Transporter of *Arabidopsis thaliana* (ZAT)

The results of TargetP 1.1 analysis of the polypeptide sequence as represented by SEQ ID NO: 249 are presented Table D1. The "plant" organism group was selected, no cutoffs defined, and the predicted length of the transit peptide requested. The subcellular localization of the polypeptide sequence as represented by SEQ ID NO: 249 is predicted to be cytoplasmic.

TABLE D1

TargetP 1.1 analysis of the polypeptide sequence as represented by SEQ ID NO: 248

| | |
|---|---|
| Length (AA) | 398 |
| Chloroplastic transit peptide | 91% |

Further features of the polypeptide sequence represented by SEQ ID NO: 249 include:
Molecular weight: 43827 Da
Theoretical pI: 6.6
Membrane protein
Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

5.2. 6-Phosphogluconate Dehydrogenase (6-PGDH)

The protein sequences representing the 6-PGDH are used to query TargetP 1.1. The "plant" organism group is selected, no cutoffs defined, and the predicted length of the transit peptide requested.
Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark Example 6

Cloning of the Nucleic Acid Sequence Used in the Methods of the Invention 6.1. Methionine Sulfoxide Reductase (Msr)
SEQ ID NO: 1
A nucleic acid sequence encoding an MSR polypeptide was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 184; sense): 5'-ggggacaagtttgtacaaaaaagcaggcttaaacaatgagctggctcgggaa-3' and (SEQ ID NO: 185; reverse, complementary): 5'-ggggaccactttgtacaagaaagctgggtgttctggttcaaacttgccc-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pOs_MSR. Plasmid pDONR201 was purchased from Invitrogen, as part of the Gateway® technology.
The entry clone comprising SEQ ID NO: 1 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 196) for constitutive specific expression was located upstream of this Gateway cassette.
After the LR recombination step, the resulting expression vector pGOS2::MSR (FIG. 2) was transformed into *Agrobacterium* strain LBA4044 according to methods well known in the art.

SEQ ID NO: 101
A nucleic acid sequence was amplified by PCR using as template a custom-made *Medicago truncatula* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 186; sense): 5'-ggggacaagtttgtacaaaaaagcaggcttaaacaatgggctcttcagcttcttct-3' and (SEQ ID NO: 187; reverse, complementary): 5'-ggggaccactttgtacaagaaagctgggttttgatcatc ttacttccttggtt-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pMt_MSR. Plasmid pDONR201 was purchased from Invitrogen, as part of the Gateway® technology.
The entry clone comprising SEQ ID NO: 101 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 188) for constitutive specific expression was located upstream of this Gateway cassette.
After the LR recombination step, the resulting expression vector pGOS2::MSR (FIG. 2) was transformed into *Agrobacterium* strain LBA4044 according to methods well known in the art.

SEQ ID NO: 163
A nucleic acid sequence was amplified by PCR using as template a custom-made *Triticum aestivum* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 189; sense): 5'-ggggacaagtttgtacaaaaaagcaggcttaaacaatgggcgccgcgccgt-3' and (SEQ ID NO: 190; reverse, complementary): 5'-ggggaccactttgtacaagaaagctgggtactactggggctt aaacttcagagac-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pTa_MSR. Plasmid pDONR201 was purchased from Invitrogen, as part of the Gateway® technology.
The entry clone comprising at least part of SEQ ID NO: 163 was then used in an LR reaction with a destination vector used for *Oryza sativa* transformation. This vector contained as functional elements within the T-DNA borders: a plant selectable marker; a screenable marker expression cassette;

and a Gateway cassette intended for LR in vivo recombination with the nucleic acid sequence of interest already cloned in the entry clone. A rice GOS2 promoter (SEQ ID NO: 188) for constitutive specific expression was located upstream of this Gateway cassette.

After the LR recombination step, the resulting expression vector pGOS2::MSR (FIG. 2) was transformed into *Agrobacterium* strain LBA4044 according to methods well known in the art.

SEQ ID NO: 23

A nucleic acid sequence encoding an MSR polypeptide was amplified by PCR using as template a custom-made *Arabidopsis thaliana* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were (SEQ ID NO: 191; sense): 5'-ggggacaagtttgtacaaaaaagcag-gcttaaacaatgcaggtcctcgtcgt c-3' and (SEQ ID NO: 192; reverse, complementary): 5'-ggggaccactttgtacaagaaa gctgggtgtgcttgagggaagactgact-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pAt_MSR. Plasmid pDONR201 was purchased from Invitrogen, as part of the Gateway® technology.

The entry clone comprising SEQ ID NO: 23 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 188) for constitutive specific expression was located upstream of this Gateway cassette.

After the LR recombination step, the resulting expression vector essentially as represented by pGOS2::MSR (FIG. 2) was transformed into *Agrobacterium* strain LBA4044 according to methods well known in the art.

6.2. Enolase (2-phospho-D-glycerate hydrolase)

The nucleic acid sequence used in the methods of the invention was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were: 5'-ggg-gaca agtttgtacaaaaaagcaggcttaaacaatggcggcgacgat-3' (SEQ ID NO: 243; sense) and (SEQ ID NO: 244; reverse, complementary): 5'-ggggaccactttgtacaagaaagctgg gttttagtagggctc-cacgg-3', which include the AttB sites for Gateway recombination. The amplified PCR fragment was purified also using standard methods. The first step of the Gateway procedure, the BP reaction, was then performed, during which the PCR fragment recombined in vivo with the pDONR201 plasmid to produce, according to the Gateway terminology, an "entry clone", pEnolase\™. Plasmid pDONR201 was purchased from Invitrogen, as part of the Gateway® technology.

The entry clone comprising SEQ ID NO: 193 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 241) for constitutive specific expression was located upstream of this Gateway cassette.

Figure 5:
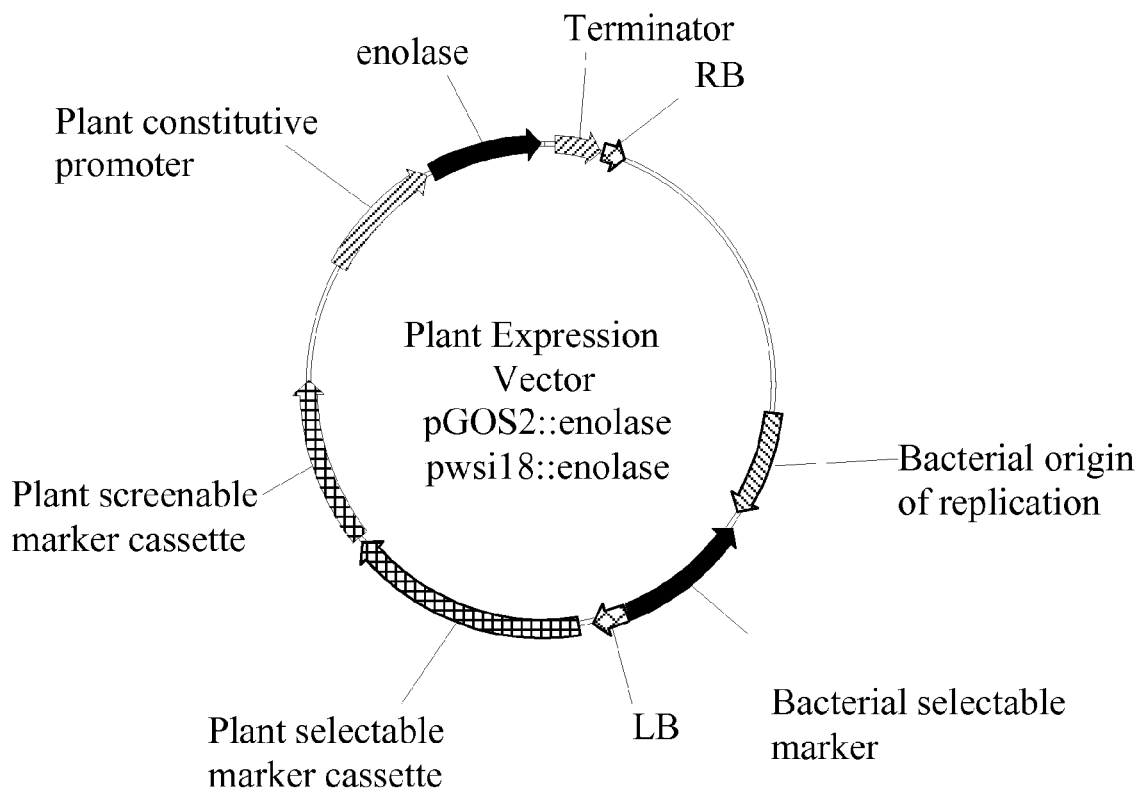
FIG. 5 represents the binary vector for increased expression in *Oryza sativa* of an Enolase-encoding nucleic acid under the control of a rice GOS2 promoter (pGOS2).

After the LR recombination step, the resulting expression vector pGOS2::ENOLASE (FIG. 5) was transformed into *Agrobacterium* strain LBA4044 according to methods well known in the art.

6.3. Zn Transporter of *Arabidopsis thaliana* (ZAT)

The nucleic acid sequence used in the methods of the invention was amplified by PCR using an *Arabidopsis thaliana* seedling cDNA library (in pCMV Sport 6.0; Invitrogen, Paisley, UK). PCR was performed using Hifi Taq DNA polymerase under standard conditions, using 200 ng of template in a 50 µl PCR mix. The primers used were (SEQ ID NO: 279; sense, start codon in bold): 5'-ggggacaagfttgtacaaaaaag-caggcttaaacaatggagtcttcaagtcccc ac-3' and (SEQ ID NO: 279-280; reverse, complementary): 5'-ggggaccactftgtacaa-gaa agctgggttagcttttagcgctcgatttg-3', which include the AttB sites for Gateway recombination. The amplified PCR fragment was purified, also using standard methods. The first step of the Gateway procedure, the BP reaction, was then performed, during which the PCR fragment recombined in vivo with the pDONR201 plasmid to produce, according to the Gateway terminology, an "entry clone", pZAT. Plasmid pDONR201 was purchased from Invitrogen, as part of the GATEWAY® technology.

The entry clone comprising SEQ ID NO: 247 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 278) for constitutive expression was located upstream of this Gateway cassette.

Figure 8:
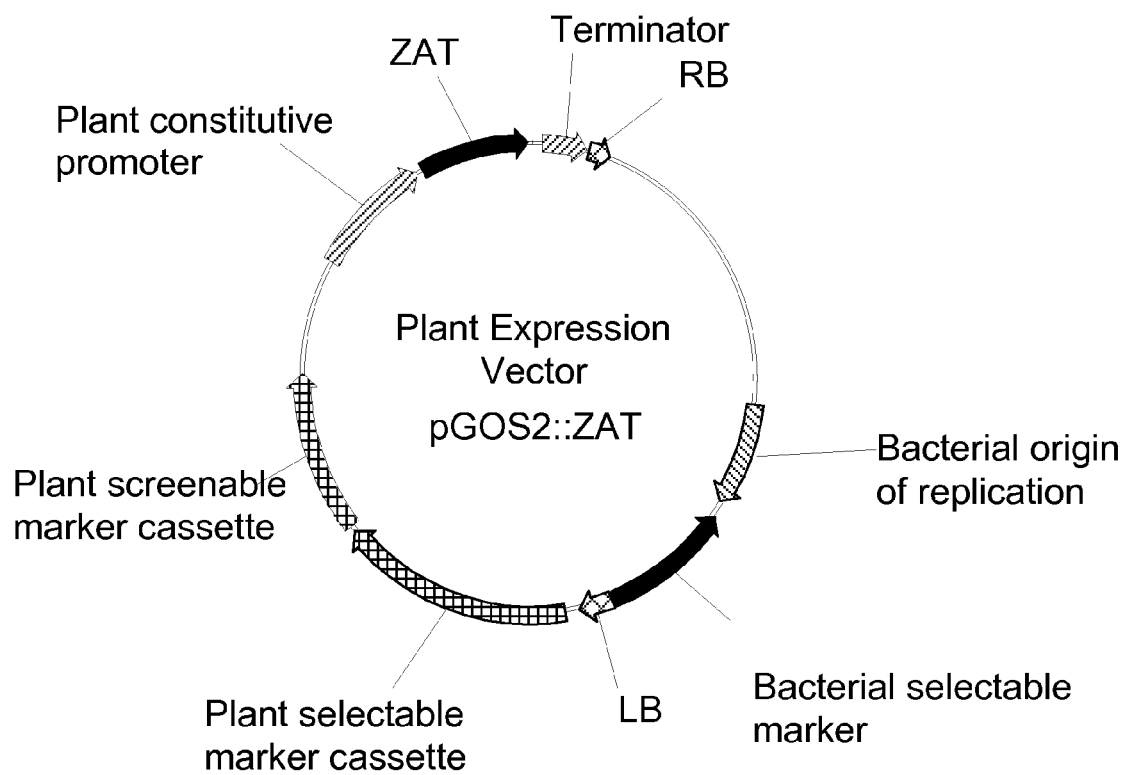
FIG. 8 represents the binary vector for increased expression in *Oryza sativa* of a ZAT-like zinc transporter polypeptide encoding nucleic acid under the control of a rice GOS2 promoter (pGOS2).

After the LR recombination step, the resulting expression vector pGOS2::ZAT (FIG. 8) was transformed into *Agrobacterium* strain LBA4044 according to methods well known in the art.

6.4. 6-Phosphogluconate Dehydrogenase (6-PGDH)

Cloning of SEQ ID NO: 281:

The nucleic acid sequence SEQ ID NO: 281 used in the methods of the invention was amplified by PCR using as template a custom-made *Oryza sativa* seedlings cDNA library (in pCMV Sport 6.0; Invitrogen, Paisley, UK). PCR was performed using Hifi Taq DNA polymerase in standard conditions, using 200 ng of template in a 50 µl PCR mix. The primers used were prm09718 (SEQ ID NO: 284; sense, start codon in bold): 5'-gggg acaagtttgtacaaaaaagcaggct-taaacaatggctgtcactagaattggt-3' and prm09719 (SEQ ID NO: 285; reverse, complementary): 5'-ggggaccactttgtacaag aaagctgggtattaccgaaaatttgaagcat-3', which include the AttB sites for Gateway recombination. The amplified PCR fragment was purified also using standard methods. The first step of the Gateway procedure, the BP reaction, was then performed, during which the PCR fragment recombines in vivo with the pDONR201 plasmid to produce, according to the Gateway terminology, an "entry clone". Plasmid pDONR201 was purchased from Invitrogen, as part of the Gateway® technology.

The entry clone comprising SEQ ID NO: 281 was then used in an LR reaction with a destination vector used for *Oryza sativa* transformation. This vector contained as functional elements within the T-DNA borders: a plant selectable marker; a screenable marker expression cassette; and a Gateway cassette intended for LR in vivo recombination with the nucleic acid sequence of interest already cloned in the entry clone. A rice GOS2 promoter (SEQ ID NO: 286) for seed specific expression was located upstream of this Gateway cassette.

After the LR recombination step, the resulting expression vector pGOS2::6-PGDH (FIG. 9) was transformed into *Agrobacterium* strain LBA4044 according to methods well known in the art.

Example 7

Plant Transformation

Rice Transformation

The *Agrobacterium* containing the expression vector was used to transform *Oryza sativa* plants. Mature dry seeds of the rice japonica cultivar Nipponbare were dehusked. Sterilization was carried out by incubating for one minute in 70% ethanol, followed by 30 minutes in 0.2% $HgCl_2$, followed by a 6 times 15 minutes wash with sterile distilled water. The sterile seeds were then germinated on a medium containing 2,4-D (callus induction medium). After incubation in the dark for four weeks, embryogenic, scutellum-derived calli were excised and propagated on the same medium. After two weeks, the calli were multiplied or propagated by subculture on the same medium for another 2 weeks. Embryogenic callus pieces were sub-cultured on fresh medium 3 days before co-cultivation (to boost cell division activity).

*Agrobacterium* strain LBA4404 containing the expression vector was used for co-cultivation. *Agrobacterium* was inoculated on AB medium with the appropriate antibiotics and cultured for 3 days at 28° C. The bacteria were then collected and suspended in liquid co-cultivation medium to a density ($OD_{600}$) of about 1. The suspension was then transferred to a Petri dish and the calli immersed in the suspension for 15 minutes. The callus tissues were then blotted dry on a filter paper and transferred to solidified, co-cultivation medium and incubated for 3 days in the dark at 25° C. Co-cultivated calli were grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential was released and shoots developed in the next four to five weeks. Shoots were excised from the calli and incubated for 2 to 3 weeks on an auxin-containing medium from which they were transferred to soil. Hardened shoots were grown under high humidity and short days in a greenhouse.

Approximately 35 independent T0 rice transformants were generated for one construct. The primary transformants were transferred from a tissue culture chamber to a greenhouse. After a quantitative PCR analysis to verify copy number of the T-DNA insert, only single copy transgenic plants that exhibit tolerance to the selection agent were kept for harvest of T1 seed. Seeds were then harvested three to five months after transplanting. The method yielded single locus transformants at a rate of over 50% (Aldemita and Hodges 1996, Chan et al. 1993, Hiei et al. 1994).

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with *Agrobacterium* (containing the expression vector) by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (*Medicago sativa*) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown D C W and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of *Agrobacterium tumefaciens* C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using *Agrobacterium tumefaciens* according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An *Agrobacterium* suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 8

Phenotypic Evaluation Procedure 8.1 Evaluation Setup

Approximately 35 independent T0 rice transformants were generated. The primary transformants were transferred from a tissue culture chamber to a greenhouse for growing and harvest of T1 seed. Six events, of which the T1 progeny segregated 3:1 for presence/absence of the transgene, were retained. For each of these events, approximately 10 T1 seedlings containing the transgene (hetero- and homo-zygotes) and approximately 10 T1 seedlings lacking the transgene (nullizygotes) were selected by monitoring visual marker expression. The transgenic plants and the corresponding nullizygotes were grown side-by-side at random positions. Greenhouse conditions were of shorts days (12 hours light), 28° C. in the light and 22° C. in the dark, and a relative humidity of 70%. Plants grown under non-stress conditions were watered at regular intervals to ensure that water and nutrients were not limiting and to satisfy plant needs to complete growth and development.

Four T1 events were further evaluated in the T2 generation following the same evaluation procedure as for the T1 generation but with more individuals per event. From the stage of sowing until the stage of maturity the plants were passed several times through a digital imaging cabinet. At each time point digital images (2048×1536 pixels, 16 million colours) were taken of each plant from at least 6 different angles.

Drought Screen

Plants from T2 seeds are grown in potting soil under normal conditions until they approach the heading stage. They are then transferred to a "dry" section where irrigation is withheld.

Humidity probes are inserted in randomly chosen pots to monitor the soil water content (SWC). When SWC goes below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T2 seeds were grown in potting soil under normal conditions except for the nutrient solution. The pots were watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters were recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

8.2 Statistical Analysis: F Test

A two factor ANOVA (analysis of variants) was used as a statistical model for the overall evaluation of plant phenotypic characteristics. An F test was carried out on all the parameters measured of all the plants of all the events transformed with the gene of the present invention. The F test was carried out to check for an effect of the gene over all the transformation events and to verify for an overall effect of the gene, also known as a global gene effect. The threshold for significance for a true global gene effect was set at a 5% probability level for the F test. A significant F test value points to a gene effect, meaning that it is not only the mere presence or position of the gene that is causing the differences in phenotype.

Because two experiments with overlapping events were carried out, a combined analysis was performed. This is useful to check consistency of the effects over the two experiments, and if this is the case, to accumulate evidence from both experiments in order to increase confidence in the conclusion. The method used was a mixed-model approach that takes into account the multilevel structure of the data (i.e. experiment-event-segregants). P values were obtained by comparing likelihood ratio test to chi square distributions.

8.3 Parameters Measured

Biomass-Related Parameter Measurement

From the stage of sowing until the stage of maturity the plants were passed several times through a digital imaging cabinet. At each time point digital images (2048×1536 pixels, 16 million colours) were taken of each plant from at least 6 different angles.

The plant aboveground area (or leafy biomass) was determined by counting the total number of pixels on the digital images from aboveground plant parts discriminated from the background. This value was averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour was determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles were harvested, counted, bagged, barcode-labelled and then dried for three days in an oven at 37° C. The panicles were then threshed and all the seeds were collected and counted. The filled husks were separated from the empty ones using an air-blowing device. The empty husks were discarded and the remaining fraction was counted again. The filled husks were weighed on an analytical balance. The number of filled seeds was determined by counting the number of filled husks that remained after the separation step. The total seed yield was measured by weighing all filled husks harvested from a plant. Total seed number per plant was measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Examples 9

Results of the Phenotypic Evaluation of the Transgenic Plants 9.1. Methionine Sulfoxide Reductase (Msr)

PGOS2:: SEQ ID NO: 1—Non Stress Conditions

The results of the evaluation of transgenic rice plants in the T2 generation and expressing an MSR nucleic acid comprising the longest open reading frame of SEQ ID NO: 1 under the control of the constitutive promoter pGOS2 in non-stress conditions are presented below. The performance of the plants in respect of different yield-related-traits is deduced from parameters measured as described in section 7.3.

An increase of at least 5% was observed for area max (aboveground biomass), emergence vigour (early vigour or EmerVigor), total seed yield (totalwgseeds), flowerperpan (number of flowers per panicle), RootThickMax (maximum biomass of the portion of roots comprising thick roots), number of filled seeds (nrfilledseed), total number of seeds (Total nr of seeds) and harvest index per plant (Table E1).

TABLE E1

Results evaluation of transgenic plants growing under non-stress conditions.

| Yield Related Trait | % Increase in transgenic compared to control plant. |
| --- | --- |
| Area Max | 5.2 |
| flowerperpan | 8.9 |
| RootThickMax | 7.5 |
| EmerVigor | 16 |
| Harvest index | 13 |
| totalwgseeds | 19 |
| Total nr of seeds | 13 |
| nrfilledseed | 20 |

PGOS2:: SEQ ID NO: 101—Non Stress Conditions

The results of the evaluation of transgenic rice plants in the T2 generation and expressing an MSR nucleic acid comprising the longest open reading frame of SEQ ID NO: 101 under the control of the constitutive promoter pGOS2 in non-stress conditions are presented below. The performance of the plants in respect of different yield-related-traits is deduced from parameters measured essentially as described in section 7.3.

An increase of at least 5% was observed for the total seed yield (totalwgseeds), number of filled seeds (nrfilledseed), seed filling rate (fillrate) and harvest index per plant (Table E2).

TABLE E2

Results evaluation of transgenic plants growing under non-stress conditions.

| Parameter | % Increase in transgenic compared to control plant |
|---|---|
| totalwgseeds | 17.1 |
| nrfilledseed | 13.5 |
| fillrate | 14.0 |
| harvestindex | 12.3 |

PGOS2:: SEQ ID NO: 163—Non Stress Conditions

The results of the evaluation of transgenic rice plants in the T1 generation and expressing an MSR nucleic acid comprising the longest open reading frame of SEQ ID NO: 163 under the control of the constitutive promoter pGOS2 in non-stress conditions are presented below. The performance of the plants in respect of different yield-related-traits is deduced from parameters measured essentially as described in section 7.3.

An increase of at least 5% was observed for the seed filling rate (fillrate) and harvest index per plant (Table E3).

TABLE E3

Results evaluation of transgenic plants growing under non-stress conditions.

| Parameter | % Increase in transgenic compared to control plant |
|---|---|
| fillrate | 10.1 |

PGOS2:: SEQ ID NO: 23—Nitrogen Use Deficiency Conditions

The results of the evaluation of transgenic rice plants in the T1 generation and expressing an MSR nucleic acid comprising the longest open reading frame of SEQ ID NO: 23 under the control of the constitutive promoter pGOS2 in nitrogen use deficiency conditions are presented below. The performance of the plants in respect of different yield-related-traits is deduced from parameters measured essentially as described in section 7.3.

An increase of at least 5% was observed in the green biomass of the transgenic plants compared to the control plants (nullyzygous plants).

9.2. Enolase (2-phospho-D-glycerate hydrolase)

The results of the evaluation of transgenic rice plants expressing an Enolase nucleic acid comprising the longest open reading frame in SEQ ID NO: 193 under the control of the rice GOS2 promoter for constitutive expression and cultivated under non-stress conditions are presented below. An increase of more than 5% was observed for harvest index (harvestindex), seed filling rate (fillrate), total seed yield (totalwgseeds or total weight of seeds), and number of filled seeds (nrfilledseed). See Table E4.

TABLE E4

| Yield-related trait | % Difference in transgenic versus control plants |
|---|---|
| totalwgseeds | 18.45 |
| nrfilledseed | 16.3 |
| fillrate | 17.0 |
| harvestindex | 21.3 |

The results of the evaluation of transgenic rice plants expressing an Enolase nucleic acid as represented by SEQ ID NO: 193 under the control of PRO0151 promoter and cultivated under non-stress conditions are presented below. An increase of more than 5% was observed for aboveground biomass (AreaMax), emergence vigour (EmerVigor or early vigour), total seed yield (totalwgseeds), and number of filled seeds (nrfilledseed). See Table E5.

TABLE E5

| Yield-related trait | % Difference in transgenic versus control plants |
|---|---|
| AreaMax | 11.5 |
| EmerVigor | 25.8 |
| totalwgseeds | 16.55 |
| nrfilledseed | 15.1 |

The results of the evaluation of transgenic rice plants expressing an Enolase nucleic acid as represented by SEQ ID NO: 193 under the control of the rice GOS2 promoter for constitutive expression and cultivated under the conditions of the drought screen of Example 7 are presented below. An increase of more than 5% was observed for the number of filled seeds (nrfilledseed), the seed filling rate (fillrate) and the number of primary panicles (firstpan or first panicles). See Table E6.

TABLE E6

| Yield-related trait | % Difference in transgenic versus control plants |
|---|---|
| nrfilledseed | 16.7 |
| fillrate | 20.4 |
| firstpan | 15.96 |

The results of the evaluation of transgenic rice plants expressing an Enolase nucleic acid as represented by SEQ ID NO: 193 under the control of PRO0151 promoter and cultivated under non-stress conditions are presented below. An increase of more than 5% was observed for the total seed yield (totalwgseeds), and number of filled seeds (nrfilledseed), the seed filling rate (fillrate) and the harvest index (harvestindex).

TABLE E7

| Yield-related trait | % Difference in transgenic versus control plants |
|---|---|
| totalwgseeds | 23.18 |
| nrfilledseed | 22.8 |
| fillrate | 37.6 |
| harvestindex | 32.8 |

9.3. Zn Transporter of *Arabidopsis thaliana* (ZAT)

The results of the evaluation of transgenic rice plants expressing a ZAT-like zinc transporter-encoding nucleic acid under non-stress conditions are presented below. An increase of at least 5% ($p \leq 0.05$) was observed for the following parameters:

TABLE E8

| Parameter | Overall |
|---|---|
| AreaMax | 24.4 |
| EmerVigor | 33.9 |
| RootMax | 18.3 |
| totalwgseeds | 9.0 |
| nrfilledseed | 8.5 |
| flowerperpan | 6.7 |

TABLE E8-continued

| Parameter | Overall |
|---|---|
| HeightMax | 17.9 |
| RootThickMax | 19.5 |
| RootThinMax | 18.3 |

9.4. 6-Phosphogluconate Dehydrogenase (6-PGDH)

The transgenic rice plants expressing the 6-PGDH nucleic acid represented by SEQ ID NO: 281 under control of the GOS2 promoter showed an increase of more than 5% for aboveground biomass (AreaMax), total weight of seeds (totalwgseeds), number of filled seeds (nrfilledseed), seed filling rate (fillrate) and total number of seeds (nrtotalseed) when grown under non-stress conditions (Table E9).

TABLE E9

| Parameter | % increase in transgenic plant compared to control plant |
|---|---|
| AreaMax | 9.1 |
| EmerVigor | 23.5 |
| totalwgseeds | 20.4 |
| nrfilledseed | 18.6 |
| fillrate | 3.8 |
| nrtotalseed | 13.4 |

SEQUENCE LISTING (393 sequences)

SEQ ID NO: 1 - DNA, 618 bp, Oryza sativa
atgagctggctcgggaagctggggctgggcgggctggggggaagcccgcgggcgtcggcggcgtcggcggcgctggcgcagggccccgatgaggaccgcccggcggccgggaacgagttcgcgcagttcggcgccgggtgcttctggggcgtggagctcgcgttccagcgcgtccccggcgtgactcgcaccgaggtgggatacagccaggggaacctccacgacccgacctacgaggacgtctgcaccggcgccacctaccacaacgaggtcgtccgcgtccactacgacgtctccgcctgcaagttcgacgacctcctcgacgtcttctgggcgcgccacgatcccaccacgcccaaccgccagggtaatgatgttgggacccaatacaggtcaggtatctactactacacccctgagcaggagaaggcggcaagagaatctctggagaagcagcagaagcttctgaatcggacgattgtcactgaaattcttcctgcaaagaggttctacagggcagaggagtaccaccagcaataccttgcgaaaggcggtcgcttcgggttcaggcagtctgcggagaagggttgcaacgaccccatccgttgctacgggtga

SEQ ID NO: 2 - protein, 205 aa, Oryza sativa
MSWLGKLGLGGLGGSPRASAASAALAQGPDEDRPAAGNEFAQFGAGCFWGVELAFQRVPGVTRTEVGYSQGNLHDPTYEDVCTGATYHNEVVRVHYDVSACKFDDLLDVFWARHDPTTPNRQGNDVGTQYRSGIYYYTPEQEKAARESLEKQQKLLNRTIVTEILPAKRFYRAEEYHQQYLAKGGRFGFRQSAEKGCNDPIRCYG

SEQ ID NO: 3 - DNA, 609 bp, Arabidopsis thaliana
atggcttcttctactagattaactattatacaatcaagcttcgtctccgcaagaacaagactcaattacgtctccaagacaaatcattctgggttcgcttgtcgttctctttcaaaacccagaaacttgagtctctctgtttattctatgggttcttctagttcttctccgaaaccagacaacgtccaagaggctgagaagaatgagtttgcttctctaagtgaaaatgaatggaagaaacggctaacaccagaacagtactacatcactagacagaagggcacagagagagctttcactggggagtattggaactcaaagacccctggagtatataattgtgtatgttgcgacacacctctatttgattcatcaacaaagtttgatagtggaacagggtggccatcttactaccaaccaattggaaacaatgtgaagacaaagctagacctctctatcatcttcatgcctagacaagaagttgtctgtgctgtttgtaacgcccatcttggtcatgtctttgacgacggtccacgcccaaccggaaaacgatattgcctcaacagtgctgctctgaaacttaacgcattggagaaaacaagagattga

SEQ ID NO: 4 - protein, 202 aa, Arabidopsis thaliana
MASSTRLTIIQSSFVSARTRLNYVSKTNHSGFACRSLSKPRNLSLSVYSMGSSSSSPKPDNVQEAEKNEFASLSENEWKKRLTPEQYYITRQKGTERAFTGEYWNSKTPGVYNCVCCDTPLFDSSTKFDSGTGWPSYYQPIGNNVKTKLDLSIIFMPRQEVVCAVCNAHLGHVFDDGPRPTGKRYCLNSAALKLNALEKTRD

SEQ ID NO: 5 - DNA, 765 bp, Arabidopsis thaliana
atggctatatcactgaagaggaaccgtttcttcattccttatacgaatctcgtcttcttcttcttcttgtgtgtctctctgctcgataaaactgtatccatcaggatttcgaatcagatctcggatactgtcgttgattctcccgatcgtcctttgaaatctgcggttttcgctcttggaagcttctggagatcggaggcggcgtttggttgtatcaatggcgtcgtacgaacctccgccggttacgccggtggaacgaagacgaatccggagtataggaacttaggtgatcacgccgagtccgtacaggttgaatatgatccaaggataattggttatcgtcagctcttagatgtattttggtctagtcatgattctagacaagtgtttggacaaggtcctgatgtgggtaatcaatacagatcctgtattttcactaattctacagaagaattgagactggcttctaccagcaaagaaagggagcaacttaatacaagaagcagtatcgtgaccactcaaattcaacagctaggaacgttttatcgcgcagagcctgatcaccagaagttcgagctgaaacaacatccatttcttattcagctaattggaaacatggtagaagaagagcttgagagatcagctctagccacaaaactaaacggttacgcagccgagctctgcccgcctagaatccagaaacatatcgactctagagttaatgagatcattagaaaaggttggcccgtcttgagagacatctaa

SEQ ID NO: 6 - protein, 254 aa, Arabidopsis thaliana
MAISLKRNRFFIPYTNLVFFFFLCVSLLDKTVSIRISNQISDTVVDSPDRPLKSAVFALGSFWRSEAAFGCINGVVRTSAGYAGGTKTNPEYRNLGDHAESVQVEYDPRIIGYRQLLDVFWSSHDSRQVFGQGPDVGNQYRSCIFTNSTEELRLASTSKEREQLNTRSSIVTTQIQQLGTFYRAEPDHQKFELKQHPFLIQLIGNMVEEELERSALATKLNGYAAELCPPRIQKHIDSRVNEIIRKGWPVLRDI

SEQ ID NO: 7 - DNA, 531 bp, Arabidopsis thaliana
atgaacatcgtcaattcaaagattctctttttatcattcacgctacttcttcttcttcaatcgtcaatcgttgaatccgattcgatttgcctctcttccggcgtagcttcgacggtggcaatggcggctccgggatcggttcagaaaggagatgaagagtggcgtgcgattctttcacctgaacagtttcggattcttcgtcaaaagggcactgaatatccaggaacaggggaatatgtcaacttcgacaaggaaggagtttacggttgtgtaggatgcaatgctcctctttataaatccaccacaaagttcaacgctggttgtggctggccagctttctttgaaggaatccccggtgccattacccgaacgacagacccagatgggagaagaatagagatcaactgtgcaacatgtggtggacatcttggtcatgttttcaaaggagaaggtttcgctactccaaccgatgaacgccattgcgtgaacagcgtttcgcttaagttcacacccgcagcgtcttccttgtaa

SEQ ID NO: 8 - protein, 176 aa, Arabidopsis thaliana
MNIVNSKILFLSFTLLLLLQSSIVESDSICLSSGVASTVAMAAPGSVQKGDEEWRAILSPEQFRILRQKGTEYPGTGEYVNFDKEGVYGCVGCNAPLYKSTTKFNAGCGWPAFFEGIPGAITRTTDPDGRRIEINCATCGGHLGHVFKGEGFATPTDERHCVNSVSLKFTPAASSL

SEQ ID NO: 9 - DNA, 420 bp, Arabidopsis thaliana
atggcggatcttgtgacggtggttaaaaaaacagaggaggagtggcgtgcagttctttctcctgaacagtttcggattctccgtcaaaagggcactgaaacgccgggaacagaagaatatgacaagttctttgaggaaggaatcttcagctgcatcggatgcaaaactcctctttataaatccaccacgaagtttgacgccggatgcggctggccagctttctttgaaggactccccggtgccattaaccgagcccctgatccagatgggagaagaactgagatcacttgtgccgtatgtgatggacatttaggccatgttcataaaggtgaaggttatagtactccaaccgatgaacgcctttgtgttaacagcgtttcgatcaattttaacccggccaaaccttcctctataacctga

SEQ ID NO: 10 - protein, 139 aa, Arabidopsis thaliana
MADLVTVVKKTEEEWRAVLSPEQFRILRQKGTETPGTEEYDKFFEEGIFSCIGCKTPLYKSTTKFDAGCGWPAFFEGLPGAINRAPDPDGRRTEITCAVCDGHLGHVHKGEGYSTPTDERLCVNSVSINFNPAKPSSIT

SEQ ID NO: 11 - DNA, 420 bp, Arabidopsis thaliana
atggcggcttctccgttggtggttcagaaaacagaggaggagtggcgtgcggttctttctccggagcagtttcgtattcttcgtcaaaaaggcactgaaaagccaggaactggagaatatgacaagtttttcgaggaaggaatcttcgattgcgtaggatgcaagactcctctttataaatcaaccacgaagttcgattccggatgtggctggccagctttctttgaaggactccctggtgccataaaccgaacccctgatccagatgggagaagaactgagatcacttgtgctgcgtgcgatggacatttaggccatgttttcaaaggagaaggttacggtaatccaaccgatgaacgtcattgcgttaacagtgtttcgatcagttttaacccggcaaaatcttcctctataatctga

SEQ ID NO: 12 - protein, 139 aa, Arabidopsis thaliana
MAASPLVVQKTEEEWRAVLSPEQFRILRQKGTEKPGTGEYDKFFEEGIFDCVGCKTPLYKSTTKFDSGCGWPAFFEGLPGAINRTPDPDGRRTEITCAACDGHLGHVFKGEGYGNPTDERHCVNSVSISFNPAKSSSII

SEQ ID NO: 13 - DNA, 462 bp, Arabidopsis thaliana
atgaacacttccccaaaaatggaaatggaaatgaaaatggaaacgaaggcggctcctgaagctggtatgatcaaaaagtccaacgaggagtggcgtacggttctatctcctgaacagtttaagattcttagagagaaatctattgaaaagagagggtcaggagaatatgtgaagttgttcgaggaaggaatctactgttgtgttggttgtggaaatccggtttataaatcaaccactaaattcgattccggttgcggttggccggctttttttgatgctattcctggcgccattaaccgaaccgaggagagagctggattaagatatgagataacttgcacaaaatgtgatggacatctaggtcatgtcttaaaaaatgaaggttttccaacaccaactgacgaacgccattgcgtcaacagcgttgctctcaagttctcttccgctatcacatctcagtga

SEQ ID NO: 14 - protein, 153 aa, Arabidopsis thaliana
MNTSPKMEMEMKMETKAAPEAGMIKKSNEEWRTVLSPEQFKILREKSIEKRGSGEYVKLFEEGIYCCVGCGNPVYKSTTKFDSGCGWPAFFDAIPGAINRTEERAGLRYEITCTKCDGHLGHVLKNEGFPTPTDERHCVNSVALKFSSAITSQ

SEQ ID NO: 15 - DNA, 435 bp, Arabidopsis thaliana
atggcagcaatgaccgcggcagcagttccagcaactggatctttccagaaacaagacgaggagtggcgtgcggttctgtctcctgagcagtttagggttctcagactaaaaggcacagataaacgaggcaaaggagagtttacaaagaagttcgaggaagggacttatagttgtgctggttgtggaactgctctttataaatcgaccactaagttcgactccggttgcggttggcctgcgttcttcgacgccatccccggtgctattaaacaaactccagaagcaggtggaagaagaatggagataacatgtgcagtgtgtgatggacatttaggccatgttttcaaaggcgaaggttactctactccaaccgatcaacgtcactgcgttaacagtgtctctctcaaattctcttctgctggttcctcccaataa

SEQ ID NO: 16 - protein, 144 aa, Arabidopsis thaliana
MAAMTAAAVPATGSFQKQDEEWRAVLSPEQFRVLRLKGTDKRGKGEFTKKFEEGTYSCAGCGTALYKSTTKFDSGCGWPAFFDAIPGAIKQTPEAGGRRMEITCAVCDGHLGHVFKGEGYSTPTDQRHCVNSVSLKFSSAGSSQ

SEQ ID NO: 17 - DNA, 432 bp, Arabidopsis thaliana
atggcaatgaccgcggctgcagttccatcaagtggatctttccagaaacaagacgaagagtggcgtgctgttctgtctcctgagcagtttagggttctcagactaaaaggaacagataaacgaggcaaaggagagtttacaaagaagttcgaggaagggacttatagttgtgctggttgtggaactgctctttataaatcgaccactaagttcgactccggttgcggttggcctgcgttcttcgacgccatccccggtgctattaaacaaactccagaagcaggtggaagaagaatggagataacatgtgcagtgtgtgatggacatctaggccatgttttcaaaggcgaaggttactctactccaaccgatcaacgtcactgcgttaacagtgtctctctcaaattcgcttctgctgattcttccaaataa

SEQ ID NO: 18 - protein, 143 aa, Arabidopsis thaliana
MAMTAAAVPSSGSFQKQDEEWRAVLSPEQFRVLRLKGTDKRGKGEFTKKFEEGTYSCAGCGTALYKSTTKFDSGCGWPAFFDAIPGAIKQTPEAGGRRMEITCAVCDGHLGHVFKGEGYSTPTDQRHCVNSVSLKFASADSSK

SEQ ID NO: 19 - DNA, 432 bp, Arabidopsis thaliana
atgccaacatcagcaacagcggtggctccatcaactggatctgtccagaaaaaagatcaagactggcgtgcgattttgtctcccgagcaatttagagttctcagggaaaagggcacagagaaccgaggtaaaggagagtataccaaactgttcgacgacggaatctatagttgtgctggttgtgcaactcctctttataagtccaccactaagttcgactctggttgtggctggccttccttcttcgatgctatccctggtgccattaaacaaacgcccgaggcaggagggagaagaatggagatcacgtgcgcggcatgtgacggacatttaggtcatgttgtcaaaggagaaggttttcccacagcgaccgatgagcgccactgcgtcaacagtgtttctctcaagttctctgaaatttcctcccaataa

SEQ ID NO: 20 - protein, 143 aa, Arabidopsis thaliana
MPTSATAVAPSTGSVQKKDQDWRAILSPEQFRVLREKGTENRGKGEYTKLFDDGIYSCAGCATPLYKSTTKFDSGCGWPSFFDAIPGAIKQTPEAGGRRMEITCAACDGHLGHVVKGEGFPTATDERHCVNSVSLKFSEISSQ

SEQ ID NO: 21 - DNA, 609 bp, Arabidopsis thaliana
atggcgttcaatatcataacacctggtcgtgtttattcagccacgtctctcactttcgtttccaccattaaagctgctttcgttaaacctcctttggcctctccgtctcgtcgtaacctccttcgtttctcatcatctcctttgtcatttccgtcgctccgtcgaggtttccacggtggtcgtattgtggcaatgggttcttctgctcctgaatcggtcaataagccggaagaagagtggcgtgcgattctttctcctgaacaatttaggattctcagacagaaaggcactgaatatccaggaactggagaatacaacaaagtattcgacgatggcatctattgttgtgcaggatgtggaactcctctctacaaatccaccaccaaattcgactctggttgtggctggccagctttctttgatggactccccggagctataacccgaacccctgatccagatgggagacgaatcgagatcacatgtgctgcttgtggaggacatcttggtcacgtttttaaaggagaaggtttccctactcctaccgatgagcgacactgtgtaaacagtatctctctcaagttcacaccagagaatccgaccctgtaa

SEQ ID NO: 22 - protein, 202 aa, Arabidopsis thaliana
MAFNIITPGRVYSATSLTFVSTIKAAFVKPPLASPSRRNLLRFSSSPLSFPSLRRGFHGGRIVAMGSSAPESVNKPEEEWRAILSPEQFRILRQKGTEYPGTGEYNKVFDDGIYCCAGCGTPLYKSTTKFDSGCGWPAFFDGLPGAITRTPDPDGRRIEITCAACGGHLGHVFKGEGFPTPTDERHCVNSISLKFTPENPTL

SEQ ID NO: 23 - DNA, 777 bp, Arabidopsis thaliana
atgcaggtcctcgtcgtctctcctccgctcatcgccgccgcatctctctctaaacctctcaattctctctctaaagccgcactctctttctccagagccaaacccatttgtcctttccctcaaacctctcgacgaccaatctccgtatacaaatccccaatgaacaaccttttcaacagactcggattcgggtctcgtcctcaagcccaagctgacccatcttccgccgcaatcgcccaaggacccgacgatgatgttccgtcttcaggtcagcaattcgcgcaatttggcgccggttgtttctggggagtggagctagcttaccagagagttcctggtgtgaccaagaccgaggttgggtatagccatggcatcgtgcacaatccgagttacgaggatgtctgtactggcactacgggacataacgaggttgttagagttcagtatgatcccaaagagtgtagctttgagagcttgcttgatgttttctggaatcgtcatgatccaaccaccttgaatcgtcagggtggggatgtgggaacgcagtatcgatcaggtatatactactacacagacgagcaagagcgcatagctcgtgaagctgttgagaaacagcagaagatattgaacaagaggattgtcacagagatacttcccgctacgaaattctacagagcagaaaattaccaccagcaatacctggcaaaagggggtcgcatgggtttaagacaatcagctgagaaaggttgcaaggatccaatccgatgctatggctaa

SEQ ID NO: 24 - protein, 258 aa, Arabidopsis thaliana
MQVLVVSPPLIAAASLSKPLNSLSKAALSFSRAKPICPFPQTSRRPISVYKSPMNNLFNRLGFGSRPQAQADPSSAAIAQGPDDDVPSSGQQFAQFGAGCFWGVELAYQRVPGVTKTEVGYSHGIVHNPSYEDVCTGTTGHNEVVRVQYDPKECSFESLLDVFWNRHDPTTLNRQGGDVGTQYRSGIYYYTDEQERIAREAVEKQQKILNKRIVTEILPATKFYRAENYHQQYLAKGGRMGLRQSAEKGCKDPIRCYG

SEQ ID NO: 25 - DNA, 657 bp, Arabidopsis thaliana
atggattcttctctgaaaactcaggaacctcaagtagtggaaacttctccttctccggtagctcaggagcctcctcaagtagctgacaaacctgcgattgttccttctccgatagctcaagagccagacaacgatgttccggcgccgggaaacgagtttgctgagttcgccgccggttgtttctggggagtggagcttgctttccagagaatccctggcgtgaccgtgactgaggtcggttacactcatgggatctctcacaatccgtcttatgaagatgtctgtacgaacaccacgaaccatgcagaagttgtcagggttcaatatgatcctaaagaatgcacttatgagacacttcttgatttgttttggtctagacataatcctaccaccttgaatcgtcagggagaacttttgggagcacaataccgatcaggtatatatttctacacaccggagcaagagaaactagcacgcgagtctctagagaaagagcagaaaaaactggaggataagattgtgactgagatcttaccggcaaagaaattctacaaagctgaagaataccatcagcagtaccttgtcaaaggtgggatgcatggaaacgctcaatcacctgcaaagagctgcaaggaccctatccgctgctatggctaa

SEQ ID NO: 26 - protein, 218 aa, Arabidopsis thaliana
MDSSLKTQEPQVVETSPSPVAQEPPQVADKPAIVPSPIAQEPDNDVPAPGNEFAEFAAGCFWGVELAFQRIPGVTVTEVGYTHGISHNPSYEDVCTNTTNHAEVVRVQYDPKECTYETLLDLFWSRHNPTTLNRQGELLGAQYRSGIYFYTPEQEKLARESLEKEQKKLEDKIVTEILPAKKFYKAEEYHQQYLVKGGMHGNAQSPAKSCKDPIRCYG

SEQ ID NO: 27 - DNA, 609 bp, Arabidopsis thaliana
atgaacatactcaacagattgggtttgggatcaagtgggcaaaccaatatggatccttctccgatcgctcagggaaatgacgatgacacaccggcgccggggaatcagtttgcccaattcggagctggatgtttctggggtgtcgagctggcgtttcagagagtcccaggggtgactcagaccgaggctggatacacccaagggaccgtagacaatccttcatacggagatgtttgttctggtaccacaggccattcggaggttgttagggttcaatatgatcttaacgattgcacctatgagtctctgcttgatttgttctggtctaggcatgatcccaccactttgaatcgccagggaaatgacgtgggaacccaatacagatctggaatatacttctacacacccgagcaggagaaactagcccgtgagtcacttgaacgtcaccagcaacaaatggagagaaagatcatgactgaaatcttgccagctaagaaattctacagagctgaagagcatcatcaacagtatctgtcaaaaggtgggcggtttggccaagggcaatccactgccaaaggctgcaacgacccaatccgctgttacggctaa

SEQ ID NO: 28 - protein, 202 aa, Arabidopsis thaliana
MNILNRLGLGSSGQTNMDPSPIAQGNDDDTPAPGNQFAQFGAGCFWGVELAFQRVPGVTQTEAGYTQGTVDNPSYGDVCSGTTGHSEVVRVQYDLNDCTYESLLDLFWSRHDPTTLNRQGNDVGTQYRSGIYFYTPEQEKLARESLERHQQQMERKIMTEILPAKKFYRAEEHHQQYLSKGGRFGQGQSTAKGCNDPIRCYG

SEQ ID NO: 29 - DNA, 609 bp, Arabidopsis thaliana
atgaacatacttaacaagctaggtataggatcaagtagacaaaccaacatggatccttctccaatcgcacaagtaatcgacgacgaagctccggcgccgggaaaccagtttactcaattcggcgccggttgtttctggagcgtggaattagcgtaccagagagttccaggagtgactcaaacagaggttggttattctcaagggatcactcacgatccttcttacaaagatgtttgttcaggtaccacgaatcatgccgagattgttcgtgttcaatatgatccaaaagagtgtagttaccagtcgctgcttgatttgttctggtctaagcatgatcccaccactttgaatcggcagggaaatgatgtgggaacccaataccgttcagggatatatttctacaacccggagcaagagaaactagcacgcgagtcactggagcggcaccagcaacaagttgacaggaaggttgtgacagagatcttaccggctaagaaattttatagagctgaggaacatcaccagcaatacttgtctaaaggagggaggtttggtcttaagcaatcaacggaaaaaggctgcaacgacccaatccgctgctacgggtaa

SEQ ID NO: 30 - protein, 202 aa, Arabidopsis thaliana
MNILNKLGIGSSRQTNMDPSPIAQVIDDEAPAPGNQFTQFGAGCFWSVELAYQRVPGVTQTEVGYSQGITHDPSYKDVCSGTTNHAEIVRVQYDPKECSYQSLLDLFWSKHDPTTLNRQGNDVGTQYRSGIYFYNPEQEKLARESLERHQQQVDRKVVTEILPAKKFYRAEEHHQQYLSKGGRFGLKQSTEKGCNDPIRCYG

SEQ ID NO: 31 - DNA, 666 bp, Glycine max
atgaacttgttgagcagaatcgttgggttgggtagcccaagggctgcacaaaacatgaattcaaccactgctcagggaccagatgatgagataccagcaccaggtcaacagtttgcccagtttggtgctggctgcttttggagtgttgagctggccttccagagggcatcaggggtgaccaagacagaagttggttatagccaggggcagttgcctaatccaagctatgaggatgtgtgtacgggaaccacacaccactcggaggttgtcagggtccaatatgatcccaatgtatgtagctatgagagtttgcttgatgtgttctgggctagacatgatcctaccacactgaatcggcagggaaatgatgtgggaacacaatacaggtctggaatatactattacacacctgaacaagagaaggcagccatagagtctttagaacaacaacagaagaagctgaacaggaagattgttactgagatccttcctgccaagaagttctacatggctgaagaataccatcaacagtaccttgagaaaggagggagatttggttccaagcaatctgcttctaagggatgcaatgatccaattctatgctatggttatattaatatgactagatgttttaagcaaggagttttcttgataagtatttcttaa

SEQ ID NO: 32 - protein, 221 aa, Glycine max
MNLLSRIVGLGSPRAAQNMNSTTAQGPDDEIPAPGQQFAQFGAGCFWSVELAFQRASGVTKTEVGYSQGQLPNPSYEDVCTGTTHHSEVVRVQYDPNVCSYESLLDVFWARHDPTTLNRQGNDVGTQYRSGIYYYTPEQEKAAIESLEQQQKKLNRKIVTEILPAKKFYMAEEYHQQYLEKGGRFGSKQSASKGCNDPILCYGYINMTRCFKQGVFLISIS

SEQ ID NO: 33 - DNA, 798 bp, Glycine max
atgagaatttgtggagcagcaatcagcagcagctacaccaccacgtccaattcccttttagtgtttgcttcctcttccctctccagtcctgcaaaaaccaagttcctgccctcactttctagattttctgtcaagcgtccgtacttcctttcccaaacttatccgcgcattgctgtgaacaagccctccatgaacctgttgaacagactcgggtttggcagcgcaagagcaacagagaacatggattcatccattcctcagggtccagatgatgacataccagcaccaggccagcagtttgccgagtttggtgctggctgtttttggggtgttgagttggccttccagagggtgcctggggtgaccaagacagaggttggttacacccaggggcttgtgcataatccaacctatgaggatgtgtgtacagggaccaccaaccactcagaggttgtaaggattcaatatgatccaaaaaattgcagctatgagactctgcttgacatgttctggtctagacatgatcctaccactctgaatagacaggggaatgatgtgggaacacagtacagatctggaatatactactacacgccggaacaagagaaggcggccaaggagtcgttggaacaacagcagaagcagttgaacaggaagattgtcactgagatccttcctgccaaaaagttctacagggcagaggagtaccatcaacagtaccttgagaagggtggccgatttggtttcaagcaatctgcttctaaaggctgcaatgatccaatccggtgctacggttaa

SEQ ID NO: 34 - protein, 265 aa, Glycine max
MRICGAAISSSYTTTSNSLLVFASSSLSSPAKTKFLPSLSRFSVKRPYFLSQTYPRIAVNKPSMNLLNRLGFGSARATENMDSSIPQGPDDDIPAPGQQFAEFGAGCFWGVELAFQRVPGVTKTEVGYTQGLVHNPTYEDVCTGTTNHSEVVRIQYDPKNCSYETLLDMFWSRHDPTTLNRQGNDVGTQYRSGIYYYTPEQEKAAKESLEQQQKQLNRKIVTEILPAKKFYRAEEYHQQYLEKGGRFGFKQSASKGCNDPIRCYG

SEQ ID NO: 35 - DNA, 606 bp, Hordeum vulgare
atgagctttgccagacccctaatctcccaaccttttctccgaagcttattaaccatgagcgggaaaccagtctgtatagataattctacaacagcggctcaaaaagcaacttttgctgctggctgtttctggggcgttgagaaaatgtgtcgggaaagctttgcatcacgcggcttggttgaagcacgcgtaggctacacaggtggtttatcttccaaccccttataccgtgctgtctgctctggtcaaacgggccattctgaggcgcttcaggtaacttttgatccgcagaaagtctcataccgacaacttgtcgagtttttttaccaaatgcacgatccgacgaccttccatcgtcaaggtgcggatcagggctcgcaatatcgttcggccatcttctatcacaaccaagagcaggaacaggtggctcgtcaagtcacccagaaagtcaacgagcaatggtggaagaacaaagtgactacagaaattgtcccggctggcgaatggtgggatgccgagcaatatcatcaacaatatttgaacaaaaaccctggcggatatgaatgtcctaatcatgtcctgcgaaaatttccgcccctactatag

SEQ ID NO: 36 - protein, 201 aa, Hordeum vulgare
MSFARPLISQPFLRSLLTMSGKPVCIDNSTTAAQKATFAAGCFWGVEKMCRESFASRGLVEARVGYTGGLSSNPLYRAVCSGQTGHSEALQVTFDPQKVSYRQLVEFFYQMHDPTTFHRQGADQGSQYRSAIFYHNQEQEQVARQVTQKVNEQWWKNKVTTEIVPAGEWWDAEQYHQQYLNKNPGGYECPNHVLRKFPPLL

SEQ ID NO: 37 - DNA, 552 bp, Hordeum vulgare
atgagcgggaaaccagcctgcacagataactctacaacagcggctcaaaaggcaacttttgctgccggctgcttctggggcgtcgagaaaatgtttcgggaaagcttcacatcgcgcggcttggtcgaagcacgcgtgggctacactggtggcctatcttccaaccccttataccgtgctgtctgctctggtcaaacgggtcattctgaggcgcttcaggtaacctttgatccgcagaaagtctcttaccgacaacttgtcgagtttttttaccaaatgcacgatccgacgacctttcatcgtcaaggtgcggaccagggctcgcaatatcgttcggccatcttctatcacaaccaagagcaggagcaggtggctcgtcaagtcacccagaaagtcaacgagcaatggtggaagaacaaagtgactacagaaattgccccggctggcgaatggtgggacgccgaacaatatcatcaacaatacttgagtaataatcctcgcggatatgaatgtcccaatcacgtcctacgtgaatttccgcctctactatag

SEQ ID NO: 38 - protein, 183 aa, Hordeum vulgare
MSGKPACTDNSTTAAQKATFAAGCFWGVEKMFRESFTSRGLVEARVGYTGGLSSNPLYRAVCSGQTGHSEALQVTFDPQKVSYRQLVEFFYQMHDPTTFHRQGADQGSQYRSAIFYHNQEQEQVARQVTQKVNEQWWKNKVTTEIAPAGEWWDAEQYHQQYLSNNPRGYECPNHVLREFPPLL

SEQ ID NO: 39 - DNA, 549 bp, Hordeum vulgare
atgtcgtcgagcaccggcgcggcgggcccggacgccgacgcgccggccggcgaggggctggagctggcgcagttcggggcgggctgcttctggagcgtggagctggcgtaccagcggctccccggcgtggcgcgcacggaggtgggctactcgcagggggacctcgacgggccgacctaccgcgacgtctgcggcggcggcaccggccactccgaggtggtgcgcgtgcactacgaccccaaggattgcccctacgccgtgctcctcgacgtcttctgggccaagcacaaccccaccacgcttaacaagcagggcaacgacgtcgggacgcagtaccggtcgggcatctactactacacggcagagcaggagcggcaggcgcgggagtcgctggcggagaagcagcgggagtggaaggagaagatcgtgacggaggtcctcccggccaggaggttctacccagctgaggactaccaccagcagtacctcgagaagggcggccagtccgccaagaaacgctgctccgaccccatccgctgctacggctga

SEQ ID NO: 40 - protein, 182 aa, Hordeum vulgare
MSSSTGAAGPDADAPAGEGLELAQFGAGCFWSVELAYQRLPGVARTEVGYSQGDLDGPTYRDVCGGGTGHSEVVRVHYDPKDCPYAVLLDVFWAKHNPTTLNKQGNDVGTQYRSGIYYYTAEQERQARESLAEKQREWKEKIVTEVLPARRFYPAEDYHQQYLEKGGQSAKKRCSDPIRCYG

SEQ ID NO: 41 - DNA, 615 bp, linum usitatissimum
atgaacatcctcaacaaactcggcttcggtttcatgtcgtcgccggactcctcctccatggacccgacgattccgcagagcccagacgacgacgtcccctccgccggacagcagttcgcccaattcggagccgggtgcttctggggagtggaattggctttccagagagtcccaggcgttaccaagacggaagtcgggtatacacagggtctgcttcataatcctagctaccaggatatctgtactggtaccaccagccattctgaggttgttagggttcagtatgatccaaaggagtgtagctacgactccctgcttgatgtcttctgggctagacatgaccccactacgctcaatcgccagggaaatgatgtgggaacacagtacagatccgggatatactattataccccggaacaggaggaagctgcaaaggcgtcaaaggaacgacatcagaagctctacaatcgaaacattgtgaccgagattttgccggcgaagaagttctaccgagctgaagagtaccaccagcagtaccttgctaaaggcggccgtatgggattgaagcagtctgctgagaagggctgtaacgatccgatcagatgctatggctaa

SEQ ID NO: 42 - protein, 204 aa, linum usitatissimum
MNILNKLGFGFMSSPDSSSMDPTIPQSPDDDVPSAGQQFAQFGAGCFWGVELAFQRVPGVTKTEVGYTQGLLHNPSYQDICTGTTSHSEVVRVQYDPKECSYDSLLDVFWARHDPTTLNRQGNDVGTQYRSGIYYYTPEQEEAAKASKERHQKLYNRNIVTEILPAKKFYRAEEYHQQYLAKGGRMGLKQSAEKGCNDPIRCYG

SEQ ID NO: 43 - DNA, 609 bp, Medicago truncatula
atgaaccttctgaacaaacttggatttggcagtggaaggtcatcagagagcatggattcaaccattcctcagggaccagatgacgatataccagcaccaggccagcagtttgctcaatttggggctggctgcttttggggtgttgaattggtcttccagagggttcctggagtgagtaagacagaggttggttacacccaggggcttttgcacaatcctacttatgaggatgtgtgttcagggaccacaaaccataacgaggttgtaagggtccaatatgatcccaaacaaggcaccttcgaaaatctgcttgatacattctggtcgaaacacgatcctactacgccaaatcgacaggggaatgatgtgggaacacagtacagatctggaatatacttttacactcctgaacaagagaaaatagctaaagagtctttggaacaacaagagaagcaattgggcaggaagattgctactgagattcttcctgccaagaagttctacagggctgaggagtaccatcaacagtaccttgagaaagggggtcgattcggtttcaagcaatctgctgctaaaggatgcaatgacccaattcggtgctatggttaa

SEQ ID NO: 44 - protein, 202 aa, Medicago truncatula
MNLLNKLGFGSGRSSESMDSTIPQGPDDDIPAPGQQFAQFGAGCFWGVELVFQRVPGVSKTEVGYTQGLLHNPTYEDVCSGTTNHNEVVRVQYDPKQGTFENLLDTFWSKHDPTTPNRQGNDVGTQYRSGIYFYTPEQEKIAKESLEQQEKQLGRKIATEILPAKKFYRAEEYHQQYLEKGGRFGFKQSAAKGCNDPIRCYG

SEQ ID NO: 45 - DNA, 591 bp, Medicago truncatula
atggctacaagtgaaggcggaaacgggaaccacaacactgcctttgacccggatttggatattccggataacccggatgacgagtttgctgagtttggtgcgggttgtttctggggtgtggagcttgcttttcagcgagttccgggagtggtgaagactgaggtcggatatacacagggtcatacaccggatcctaattacaaactggtttgtactggaactaccaatcatgtggaagttgttcgggttcagtttgacccgaaactgtgtccttacacgaatctattggatctgttttggtcacgacatgaccccactaccctgaatcgtcagggaggtgatgtaggtgcacaatatagatcaggaatatattactacaatgaaacacagtctcgtttagcccaagaatcaaaagaagctaaacaattggaacataaggacaagattgtaactgaaattcttccagcaaagaggttttatagagctgaggaatatcatcagcagtatttggaaaagggtggaggcaaaggccgaggtcacggtcagtctgctcaaaagggctgtaatcatcccataaggtgctatggatga

SEQ ID NO: 46 - protein, 196 aa, Medicago truncatula
MATSEGGNGNHNTAFDPDLDIPDNPDDEFAEFGAGCFWGVELAFQRVPGVVKTEVGYTQGHTPDPNYKLVCTGTTNHVEVVRVQFDPKLCPYTNLLDLFWSRHDPTTLNRQGGDVGAQYRSGIYYYNETQSRLAQESKEAKQLEHKDKIVTEILPAKRFYRAEEYHQQYLEKGGGKGRGHGQSAQKGCNHPIRCYG

SEQ ID NO: 47 - DNA, 411 bp, Oryza Sativa
atggcgtcgtcgggggacagcagcggcaagcagcggagcgacgaggagtggcgcgccgtcctctccccggagcagttccgcatcctccgcctcaagggcaccgagttacctggaacaggtgagtacaacaagttctatggtgatggggtctacaactgtgctggctgtggaacacccctgtacaaatccacaaccaagtttgattctggttgtggctggccagcattttttgagggacttcctggagccataaaccgaacaccggatcctgatggaaggagggtagaaatcacgtgtgcagcttgcggtgggcatttgggtcacgtgttcaaaggagaaggcttcaagacgcctactgatgagcgtcactgtgtgaacagtgtttcgatcaagttcaccccggcctcctaa

SEQ ID NO: 48 - protein, 136 aa, Oryza Sativa
MASSGDSSGKQRSDEEWRAVLSPEQFRILRLKGTELPGTGEYNKFYGDGVYNCAGCGTPLYKSTTKFDSGCGWPAFFEGLPGAINRTPDPDGRRVEITCAACGGHLGHVFKGEGFKTPTDERHCVNSVSIKFTPAS

SEQ ID NO: 49 - DNA, 564 bp, Oryza Sativa
atgtccgactccaaccccggcgcggcgaaccctgccctggggccggacgccgacgcggcggccggcgagggccttgagctggcgcagttcgcggcggggtgcttctggagcgtggagctgacgtaccagcgtctcccgggcgtggcgcgcacggaggtgggctactcgcagggccaccgccacgagccgacctaccgcgacgtctgcggcggcggcacggggcacgccgaggtggtgcgcgtgcactacgaccccaaggcctgcccctacgaggtcctcctcgacgtcttctgggccaagcacaaccccaccacgctcaacagacagggcaacgacgtcgggacgcagtaccggtcgggcatctactactacacggcggagcaggagaaggcggcgcgggattcgctggcggagaagcagaaggagtggaaggagaggatcgtgacggagatcctcccggcgacgaggttctaccccgccgaggagtaccaccagcgctacctcgagaagggcggccagtccgccaagaagagctgcaacgaccccatccgttgctacggctga

SEQ ID NO: 50 - protein, 187 aa, Oryza Sativa
MSDSNPGAANPALGPDADAAAGEGLELAQFAAGCFWSVELTYQRLPGVARTEVGYSQGHRHEPTYRDVCGGGTGHAEVVRVHYDPKACPYEVLLDVFWAKHNPTTLNRQGNDVGTQYRSGIYYYTAEQEKAARDSLAEKQKEWKERIVTEILPATRFYPAEEYHQRYLEKGGQSAKKSCNDPIRCYG

SEQ ID NO: 51 - DNA, 690 bp, Oryza Sativa
atgggcgtccagcatctgctcaagctgaggatggcgtcgccccacccgcacccgcaccccggcgcgccgctcgccgcgcgcccgctctccgcgctcgcctccttcttcctcgcccggccctcctccaccgccgccgcgcctcctcctcggcacgtcaccctctcgtgctcgcggccgcactgcaaccacaaccagtgggccgccagccggtgccgcgggacggcgggccggcggcggctgcaggtcgtcgtggcgatgtcctcgtcggcgccgccgccgcctccgggatccgtgcagaagtcggaggaggagtgggaggccatcctctcgccggagcagttccgcatcctccgcctcaagggcacggagtatcctggaacaggtgaatatgacaagctcttcgctgagggtgtttatgaatgtgctggatgcgggactccattgtacaagtcatctactaaattcaactcaggttgtggttggccagcattctatgaaggatttcccggagccatcgcacgaacgcctgatcctgatggcaggcgaatagagatcacctgtgcggcttgcggaggacatttaggacatgtcttcaaaggggaggggttcaacacgcctacagatgagcggcattgtgttaacagtatctcactcaagttcattccagcctcagaagatagtaagctttga

SEQ ID NO: 52 - protein, 229 aa, Oryza Sativa
MGVQHLLKLRMASPHPHPHPGAPLAARPLSALASFFLARPSSTAAAPPPRHVTLSCSRPHCNHNQWAASRCRGTAGRRRLQVVVAMSSSAPPPPPGSVQKSEEEWEAILSPEQFRILRLKGTEYPGTGEYDKLFAEGVYECAGCGTPLYKSSTKFNSGCGWPAFYEGFPGAIARTPDPDGRRIEITCAACGGHLGHVFKGEGFNTPTDERHCVNSISLKFIPASEDSKL

SEQ ID NO: 53 - DNA, 765 bp, Oryza Sativa
atggcacgcggatccgccgccgcggcgatcgccggagttgtgtgggtgcttctcctcctcgtgggggtggcgtcgggggcgcgtcttccgggcgggagcgggggtaaccgggggcgggagccgcgcgggggagcggcggcggcggcggtggccacggagacggcggtgttcgcgctgggaagcttctggaggtcggaggccgcgttcgggtgcctccccggcgtgatccgcacctccgtcggctacgccggcgggtccaaggcccgccctgagtaccgcaacctcggcgaccacgccgagtgcgtcaaggttgaatatgatccccggttgattcagtacaagaaacttctagaggtcttctgggcaagtcatgatccacgagaggtctttgggcaaggaccagatgttggcaaccaatacagatccatcatcttcacaaatggatccgtggaagctagattggctggtcttagcaaagaaaaagaacaagctaaggatcgccgcagtgtcattaccacacagatccaaccaataggtgcattttatccggctgaaccggaacatcagaaatttgagctgaagcgcaagccgtttctcctgcaactgattgggaacctgcccgaggaggagctcctgacctcaacactagctgcaaagttgaatgcatacgctgctgagctctgctccccaaatacccagaacagaataaactccaagattgatgagattgctaagaaaggatggcccatcctaagagacatttag

SEQ ID NO: 54 - protein, 254 aa, Oryza Sativa
MARGSAAAAIAGVVWVLLLLVGVASGARLPGGSGGNRGREPRGGAAAAAVATETAVFALGSFWRSEAAFGCLPGVIRTSVGYAGGSKARPEYRNLGDHAECVKVEYDPRLIQYKKLLEVFWASHDPREVFGQGPDVGNQYRSIIFTNGSVEARLAGLSKEKEQAKDRRSVITTQIQPIGAFYPAEPEHQKFELKRKPFLLQLIGNLPEEELLTSTLAAKLNAYAAELCSPNTQNRINSKIDEIAKKGWPILRDI

SEQ ID NO: 55 - DNA, 639 bp, Oryza Sativa
atgcggcaatacgcggctgctaccgctgcctcctccagtttcagagcacgtccacgggcgcgcccctcctgcctcccagccgccgccctgcccttggcgccttgctgtggtgtggcgtggagccgtgctagctacaggcgagcctccgttcgtgccatgggtgccgcttcatcgtcttcgtcgtcgtcgtcgtcgtctccgtcgccgcagggtcaagcccaagcccaagcccaaggtaaaccgaactacagtacatctctgactgatgaggagtggaggaagcgcctgacaaaagatcagtattacattactcggcagaagggcacagaaagagcatttactggggaatactggaacaccaaaaccccgggcatctaccattgtgtctgctgtgacacccctctttttgagtcatcgaccaaatttgatagtggtactgggtggccgtcatattatcaacccattggagataatgtaaagtgcaagcttgatatgtccatcatattcatgcctcggactgaggtgctgtgtgctgtctgtgacgctcatctggggcacgtgtttgatgatgggccacgaccaacagggaaaagatactgtatcaatagcgcatctctcaagctgaagaagacccagtag

SEQ ID NO: 56 - protein, 212 aa, Oryza Sativa
MRQYAAATAASSSFRARPRARPSCLPAAALPLAPCCGVAWSRASYRRASVRAMGAASSSSSSSSSSPSPQGQAQAQAQGKPNYSTSLTDEEWRKRLTKDQYYITRQKGTERAFTGEYWNTKTPGIYHCVCCDTPLFESSTKFDSGTGWPSYYQPIGDNVKCKLDMSIIFMPRTEVLCAVCDAHLGHVFDDGPRPTGKRYCINSASLKLKKTQ

SEQ ID NO: 57 - DNA, 792 bp, Oryza Sativa
atgcctcctctcctcgcctccacctcctccacgtcccctctcctcctcgcctctcgcctccgcggaggcggcggctgcggctgcggcggcgcccctctcctccaccggacgcgccgcggcttcctcgcgccgagcaccaccaccacccagacgacgaggacgagtttcgcggcgatgagctggctcgggaagctggggctgggcgggctggggggaagcccgcgggcgtcggcggcgtcggcggcgctggcgcagggccccgatgaggaccgcccggcggccgggaacgagttcgcgcagttcggcgccgggtgcttctggggcgtggagctcgcgttccagcgcgtccccggcgtgactcgcaccgaggtgggatacagccaggggaacctccacgacccgacctacgaggacgtctgcaccggcgccacctaccacaacgaggtcgtccgcgtccactacgacgtctccgcctgcaagttcgacgacctcctcgacgtcttctgggcgcgccacgatcccaccacgcccaaccgccagggtaatgatgttgggacccaatacaggtcaggtatctactactacacccctgagcaggagaaggcggcaagagaatctctggagaagcagcagaagcttctgaatcggacgattgtcactgaaattcttcctgcaaagaggttctacagggcagaggagtaccaccagcaataccttgcgaaaggcggtcgcttcgggttcaggcagtctgcggagaagggttgcaacgaccccatccgttgctacgggtga

SEQ ID NO: 58 - protein, 263 aa, Oryza Sativa
MPPLLASTSSTSPLLLASRLRGGGGCGCGGAPLLHRTRRGFLAPSTTTTQTTRTSFAAMSWLGKLGLGGLGGSPRASAASAALAQGPDEDRPAAGNEFAQFGAGCFWGVELAFQRVPGVTRTEVGYSQGNLHDPTYEDVCTGATYHNEVVRVHYDVSACKFDDLLDVFWARHDPTTPNRQGNDVGTQYRSGIYYYTPEQEKAARESLEKQQKLLNRTIVTEILPAKRFYRAEEYHQQYLAKGGRFGFRQSAEKGCNDPIRCYG

SEQ ID NO: 59 - DNA, 678 bp, Ostreococcus tauri
atgatcggcgtcgggggcgacgggatcgtgtccgcggcggaggcgttgccgggacgggcggaggcgatgcggacgccggaggcgcactacgtcttgcgaccgaatcgaatgacggcgccgtggccggagggacacgaagtggcggtgatcgcgagtggatgcttctgggggagcgaaaagggggcgtggcgcatcccaggggtgtactccacggcggtggggtacgtgggcggacacacgaagaatccgacgtacgaagaggcgtgcagcggacgaacgggacacacggagggggtgcagatcgtgttcgatccgaacgtggtgtcgtacgcggatattctggcgttattttggacgtcgcacgatccgacgcagggaatgcgacaagggaacgatcgcgggacgcagtacaggagcggtatttactgcacgacggatgcgcagttgaagatggcgctcgactccaaggaggcgtacgaacgcgctctgaaggcttcgggacgcggctcgatcacgactgagatcaagggcccgggtgacgtgttttactacgccgaagcgtaccaccagcaatacttggcgaaacccaacgctcgaccggtgcgcatcgacggaatcgacgcgacgacgcgaggacgagtctcgatcgaaaacctcgtttcgcgaacacacgactga

SEQ ID NO: 60 - protein, 225 aa, Ostreococcus tauri
MIGVGGDGIVSAAEALPGRAEAMRTPEAHYVLRPNRMTAPWPEGHEVAVIASGCFWGSEKGAWRIPGVYSTAVGYVGGHTKNPTYEEACSGRTGHTEGVQIVFDPNVVSYADILALFWTSHDPTQGMRQGNDRGTQYRSGIYCTTDAQLKMALDSKEAYERALKASGRGSITTEIKGPGDVFYYAEAYHQQYLAKPNARPVRIDGIDATTRGRVSIENLVSRTHD

SEQ ID NO: 61 - DNA, 774 bp, Ostreococcus tauri
atgcaagctattcggaacatgttcggcggcgccggcggcgaacgcgtaccgatgaagatcaatccaaaacatttcattctgaaaactgacgtcacgaccgtcccttccggtcacgcgagcttcgtcgccgccaccgggtgcttctggggcagcgagaagatgttctggcgcgtcccaggggttcgggcgacgtcggtggggtacattgcgggtaagattgagcacccgacgtacgaggagatttgcggcggacgcacgggacacgccgagtgcgttcgggtgatctacgacccgaagatcgtgtcgttcgcggatctgttggcgatgcactggacatcgcatgacccgacgcagggtgatgggcaagggaacgatcgcgggacgcagtacaggagcggattgtattgctcgacggatgagcagttgaagatggcgagagactcgagagaggcagatcacgaccgagatcaaggggcccggggatactttttacttcgccgaggattaccatcagcagtacttgggtgcgtttgtctttcaaatctctttcgcgacgttctcacgactcctctcttttcacgcgcagcgaaaccgggatctagaaagtactgcagcgccgagcccacgggcgtgcccatgcccactgcgtggctcaaggcgaacggggggaaatttggaccgggtttttgggccaagtacggtcctaaaccggggtgcacgatcggcgtcccggacgcgcaagtctcgctcgacgccgcgctcgaagcaaagtga

SEQ ID NO: 62 - protein, 257 aa, Ostreococcus tauri
MQAIRNMFGGAGGERVPMKINPKHFILKTDVTTVPSGHASFVAATGCFWGSEKMFWRVPGVRATSVGYIAGKIEHPTYEEICGGRTGHAECVRVIYDPKIVSFADLLAMHWTSHDPTQGDGQGNDRGTQYRSGLYCSTDEQLKMARDSREADHDRDQGARGYFLLRRGLPSAVLGCVCLSNLFRDVLTTPLFSRAAKPGSRKYCSAEPTGVPMPTAWLKANGGKFGPGFWAKYGPKPGCTIGVPDAQVSLDAALEAK

SEQ ID NO: 63 - DNA, 507 bp, Physcomitrella patens
atggcgcaactggcgacttttgctgctggatgtttctggagcgtggaattggcgtttcagcgcgttcctggtgttaccaagacatcggttggttacactcaggggaaaacggagaatcctacatacagggacgtctgcagcgggaagactgggcatgtggaagccgtgcaaatggagtatgatccttctcaggtctcttacaagcagctcctcgatgtcttctggaagaaacatgatcccactcagaagaaccgccagggtaacgacgtaggatcacagtaccgctcgggaatctattatcacacggaggagcagaaagtggaggcaattgcctcaatgaaggaggaagaagctcggttgaagaagcaaattgccacagagattcttcccgcaacaacttattatctggcggaggagtatcatcagcagtatctggagaagggcgtaagcgggcggaaacaatcagctgccaagatgtgcaatgaccccatccgctgttacggttaa

SEQ ID NO: 64 - protein, 168 aa, Physcomitrella patens
MAQLATFAAGCFWSVELAFQRVPGVTKTSVGYTQGKTENPTYRDVCSGKTGHVEAVQMEYDPSQVSYKQLLDVFWKKHDPTQKNRQGNDVGSQYRSGIYYHTEEQKVEAIASMKEEEARLKKQIATEILPATTYYLAEEYHQQYLEKGVSGRKQSAAKMCNDPIRCYG

SEQ ID NO: 65 - DNA, 255 bp, Physcomitrella patens
atgcaggcggtgaggttgtctgggacgatctgcgcgtcgttgctggcgcagagcgaagctcaattgggagccgctggaacattgcacacgaaagcggtgttgctgggcgcgaggccgtcgaggagtttgtctgtgaggagagggtcgtcgttctccgggacgagaatggcgtcggagaagggcggctggatggagaagttggggtttggtgcgcgggcttcggcagcgcaggcaactggcgcggcggggagctcg

SEQ ID NO: 66 - protein, 267 aa, Physcomitrella patens
MQAVRLSGTICASLLAQSEAQLGAAGTLHTKAVLLGARPSRSLSVRRGSSFSGTRMASEKGGWMEKLGFGARASAAQATGAAGSSTGARSPDDDVPAPGHEFATFGAGCFWGVELAFQRVHGVSHTEVGYTQGHIDNPDYYAVCSGDTGHSEVVRVQYDPKECSYNTLLDVFWKRHDPTTLNRQGNDRGTQYRSGIYFYSPEQEKAALESKEQVQKTLSNPIVTEILPAKKFYRAEEYHQQYLAKGGRGGNAQSPAKGCTDPIRCYG

SEQ ID NO: 67 - DNA, 819 bp, Physcomitrella patens
atgtcgcaggccacatcgttcgctgcaacagcaggcaccctcgtggtagcctcggcgcgggccaacgccagctcttcctgttccaccactcgcagctcgcaattgggttcctccttcttcgaccggaggttgaagatccgtcaagttactaagggatctctcgccaaggggtcgcagagggaggtcactgctgtgagagccatggacagctttctgggaatgttgggactcggctcgcacggccctgcgaacttcgaccctgctgatgttgcgattgcgcagggtccggacgatgacaaacccgtgagtggatgcgagttcgcatgttttggagctgggtgcttctggggcgtggagctcgcgtatcagcgtgtgccaggtgtgtacaagacagaagtgggttacacgcaagggcaaatgcacatgcccacatatgaggccgtctgctcgggcatgacaggtcattctgaagttgttagggtgcagtataatcctgcggaggtcagttacgagactctgctcggtgtattctgggatcgtcatgatcccacaaccctaaatcgacagggtggtgatgttggaactcaatatcgatctggtatctacacctacacgcctgagcaagagagaatagccaagcagtcactcgaaaaccaccagaggtccttgaaccggaaaattgtgaccgagatccttccggccaaaaagttctatcgagcagagaactatcaccagcagtatttggctaagggtggcaggatgggctttaagcagtccgcagagaagggatgcaaggacccaatccggtgctacggctaa

SEQ ID NO: 68 - protein, 272 aa, Physcomitrella patens
MSQATSFAATAGTLVVASARANASSSCSTTRSSQLGSSFFDRRLKIRQVTKGSLAKGSQREVTAVRAMDSFLGMLGLGSHGPANFDPADVAIAQGPDDDKPVSGCEFACFGAGCFWGVELAYQRVPGVYKTEVGYTQGQMHMPTYEAVCSGMTGHSEVVRVQYNPAEVSYETLLGVFWDRHDPTTLNRQGGDVGTQYRSGIYTYTPEQERIAKQSLENHQRSLNRKIVTEILPAKKFYRAENYHQQYLAKGGRMGFKQSAEKGCKDPIRCYG

SEQ ID NO: 69 - DNA, 618 bp, Physcomitrella patens
atggatagtttcttgagcatgctgggtttcaattctcgacgagcttcctcgtacaacccagctgacgttgctatttcagaagggccggatatcgacaagcccgcgagtgggaatcagtttgcttgttttggagctgggtgtttctggggcgtggagcttgcgtatcagcgcgtgccgggtgtgacctacacggaggttgggtatacgcaggggcaattgcacaaccctacatacgaagcagtctgctcgggcgacacaggacattcagaagtagtgaggttacagtataatccagctgaagtcagttacgaggatttgctcaatgtattttggaatcgccatgatcctactacgctcaaccgccaggttggtgattctggaccacaataccgatctggcatctactactactcacctgagcaagaaagagtagccaaggaatcacttgcaaaccatcagaaatctctgagccgaaagattgttactgaggttctcccagctaaaaagttctacaaagcagagtcctatcatcagcagtatttaagtaagggtggcaggatgggttcaaaacagtcagcagcgaaaggttgcaaagattctatcagatgctacggctga

SEQ ID NO: 70 - protein, 205 aa, Physcomitrella patens
MDSFLSMLGFNSRRASSYNPADVAISEGPDIDKPASGNQFACFGAGCFWGVELAYQRVPGVTYTEVGYTQGQLHNPTYEAVCSGDTGHSEVVRLQYNPAEVSYEDLLNVFWNRHDPTTLNRQVGDSGPQYRSGIYYYSPEQERVAKESLANHQKSLSRKIVTEVLPAKKFYKAESYHQQYLSKGGRMGSKQSAAKGCKDSIRCYG

SEQ ID NO: 71 - DNA, 747 bp, Physcomitrella patens
atgggagttgaggtggtatgtcagatggtgaagtctagggttttgtatttatgggctgtgactgtgggagtcttggtcgttcaagtggtcgcaatcagacccgatcagacttcgaagaacatgggagaaacgagggttgcttcctttgcgctgggatccttttggcgaggagaggcagcgtttggttgtttgccaggggtggtgagaactagggcggggtatgcgggagggttgaaacaaaaccctgattaccacagcgttggcgatcatgccgaagctgtagaggtagaatataacccaagcatgatctcgtttgagcagctgttgaaggttttttgggccaatcacgatcccactcaaattttcgggcagggtccagacgttggtccgcagtacaggtcggtggttttcacacaagacgatgaggaagctgctgtagccgcaaagagcaaagcggcggagcagaataagctgccacagagcgaagttgtgacagagattcagagtatgggggttttctacctcgcagaggcagaacatcagaaattcgagcttcgaaggaaaccccaattgttccaacttttgggcgatatttcagacgaagacctgacttcttcagttttggcgacgaagctgaacggatatgctgcaaatttgtgccctccaaacatgaagaaactcctggatactaaggtcagtccttttctgctgactcgacctaatctacagcagattctgcagttttag

SEQ ID NO: 72 - protein, 248 aa, Physcomitrella patens
MGVEVVCQMVKSRVLYLWAVTVGVLVVQVVAIRPDQTSKNMGETRVASFALGSFWRGEAAFGCLPGVVRTRAGYAGGLKQNPDYHSVGDHAEAVEVEYNPSMISFEQLLKVFWANHDPTQIFGQGPDVGPQYRSVVFTQDDEEAAVAAKSKAAEQNKLPQSEVVTEIQSMGVFYLAEAEHQKFELRRKPQLFQLLGDISDEDLTSSVLATKLNGYAANLCPPNMKKLLDTKVSPFLLTRPNLQQILQF

SEQ ID NO: 73 - DNA, 468 bp, Populus trichocarpa
atgggcaggcttcccgcccgactgggcttcctccatcgagatcagctgttcatcatgagctttcccatccacaagaccgaacaggaatggcaggccgagctgcaggccaagggcgccgaacctgccgccttccaggtgacacgccatgcagccaccgagcgcccgttcaccggccgctatgagcagttctgggccgatggcagctaccactgcatctgctgcggcagcaagctgttcgactccgacaccaagttcgatgccggctgcggctggcccagcttcgaccgcgccatccccggcgccatcaccgaaatcgtggaccgcagccacggcatggtgcgcaccgaaaccgtctgcagccagtgcggcgcccacctggggcatgtattccccgacggcccctccgacacagggctgcgctactgcatgaattccgcatcgctggaattcgagccgcccaaggcctag

SEQ ID NO: 74 - protein, 155 aa, Populus trichocarpa
MGRLPARLGFLHRDQLFIMSFPIHKTEQEWQAELQAKGAEPAAFQVTRHAATERPFTGRYEQFWADGSYHCICCGSKLFDSDTKFDAGCGWPSFDRAIPGAITEIVDRSHGMVRTETVCSQCGAHLGHVFPDGPSDTGLRYCMNSASLEFEPPKA

SEQ ID NO: 75 - DNA, 471 bp, Populus trichocarpa
atgcgcatcaccagacgctttctgctttcgggcggctcgctgaccgctacgcttgccgccgtcggcggctggcggctgctggccgccggcaatgccaacgccgccggaagcggcgcccaatccttcgaagtcacattgagcgatgaggcgtggcgccagaagctgacgccggcccagtacacggtactgcgccacgaaggcaccgagcgccccttcagcagcccactcaatgatgagcatcgcaagggcgttttctcgtgcgcgggctgccagctcgacctgttctcgtcgtcaaccaagttcgacagcggcactggttggccgagcttctgggcgccgctggccaacgcagtgggcaccaccgaggaccgcacgttcggcatggtgcgcacggcagtgcattgccgccgatgcggtggccaccttggccacgtgttcgacgacggccctaacaggctgctgaagtactag

SEQ ID NO: 76 - protein, 156 aa, Populus trichocarpa
MRITRRFLLSGGSLTATLAAVGGWRLLAAGNANAAGSGAQSFEVTLSDEAWRQKLTPAQYTVLRHEGTERPFSSPLNDEHRKGVFSCAGCQLDLFSSSTKFDSGTGWPSFWAPLANAVGTTEDRTFGMVRTAVHCRRCGGHLGHVFDDGPNRLLKY

SEQ ID NO: 77 - DNA, 468 bp, Populus trichocarpa
atgaccgccttcgacctgacgccccccactgccacccagaccgaggcgctggtcgccggcctcagcagcgaagagcgccgcgtgctgctgcagcacggcaccgaggcaccgttctgtggcgtgttcctcgacaacaagcgtgagggcgtctactgctgccggctgtgcgcgctgccgctgttccgctccagtaccaagttcgattccggcactggctggcccagcttcttcgcgccgttcgacccggcgcatgtgcgcgagatccgcgataccagccacggcatggtccgcaccgagatcacctgcgcgcgctgcggcagccacctgggccacgtgttcccggacggcccgccgccgacctacgagcgccactgcctgaactccgtctcactttcgttcaccggcaatggcgagccctggcccgatccgctgcagcgcggcggcgctgaagccggcgtggcgggctga

SEQ ID NO: 78 - protein, 155 aa, Populus trichocarpa
MTAFDLTPPTATQTEALVAGLSSEERRVLLQHGTEAPFCGVFLDNKREGVYCCRLCALPLFRSSTKFDSGTGWPSFFAPFDPAHVREIRDTSHGMVRTEITCARCGSHLGHVFPDGPPPTYERHCLNSVSLSFTGNGEPWPDPLQRGGAEAGVAG

SEQ ID NO: 79 - DNA, 789 bp, Populus trichocarpa
atgctccaaactctatccacccatctctcctccacctccacctccacctccaccaccacacctctcctcctcctctcaaaacccttcctgtctccctctgcaaaatcccagctttctcactctaaacccttcaacttccctcgaaccttaaaacccatctcttattacaagccccccatgaacatccttagcaaactaggctttggtactaggtcacctgacccatccacaatggacccaacaatcccacaaggtcctgacgatgacttaccagctcctggtcagcaatttgctcagtttggagctggttgtttttggggtgttgaattggcatttcaaagagtcccgggcgttaccaaaactgaagtgggttatactcaaggcttatcacataatccaagttatgaagatgtttgtactggtactaccaagcatagcgaagttgttagggttcagtatgaccctaaagagggtagctttgagactttgcttgatgctttttgggctagacatgatcctactaccttgaatcgccaggggaatgatgtgggaacacagtacaggtctggaatatactattacacccctgagcaggagaaggcagcaaaggaatccatggaacagcagcagaagctctcaaacaggaaaatagtcacggagattttacctgccaaaaaattctaccgagcagaagaataccaccaacagtatcttgccaaaggaggccgttttggatttaaacaatcttctgagaaaggctgcaatgatccaatcagatgctatggctaa

SEQ ID NO: 80 - protein, 262 aa, Populus trichocarpa
MLQTLSTHLSSTSTSTSTTTPLLLLSKPFLSPSAKSQLSHSKPFNFPRTLKPISYYKPPMNILSKLGFGTRSPDPSTMDPTIPQGPDDDLPAPGQQFAQFGAGCFWGVELAFQRVPGVTKTEVGYTQGLSHNPSYEDVCTGTTKHSEVVRVQYDPKEGSFETLLDAFWARHDPTTLNRQGNDVGTQYRSGIYYYTPEQEKAAKESMEQQQKLSNRKIVTEILPAKKFYRAEEYHQQYLAKGGRFGFKQSSEKGCNDPIRCYG

SEQ ID NO: 81 - DNA, 471 bp, Populus trichocarpa
atgcaatttgactatgtagagtatgacccgaaggtgattagttacagtcaactcttggaggtattttgggctagtcatgattcaaggcaagtgtttgggcaaggtcctgatgtgggtaatcaatataggtctgttattttcactaatggaactgaagagcgtagattggctggtgttagcaaagaaagagagcagttgaagttgaggagcagtgttgtggttactcaaattcaacagcttggaacattttatcctgcagagccagaacatcagaaatttgagctcaagcagaatccatttattcgtcagctgatgggaaacttgcctgaagcggaccttgagaattcaagtttggcagcaaaattaaatggctatgcagcagagctctgccctccacgcattcaaaagcagatcaatgcaaagatcaatgacattcttagaaaaggttggcctgttctgagagatgtatag

SEQ ID NO: 82 - protein, 156 aa, Populus trichocarpa
MQFDYVEYDPKVISYSQLLEVFWASHDSRQVFGQGPDVGNQYRSVIFTNGTEERRLAGVSKEREQLKLRSSVVVTQIQQLGTFYPAEPEHQKFELKQNPFIRQLMGNLPEADLENSSLAAKLNGYAAELCPPRIQKQINAKINDILRKGWPVLRDV

SEQ ID NO: 83 - DNA, 402 bp, Populus trichocarpa
atggcaggaggaggttcggtgcagaaaaccgaggaagaatggagggctgttctctcccccgagcagtttcacatccttcgtgacaagggaacagagccgaaattcagtggagaatatgataagttttttgagcaaggagttttcaattgtgctggttgtgggacacctctttacaaatccaccaccaaattcaactctggctgtggctggcctgctttctatgaaggtcttcctgctgcgataaatcgatctccggaccctgatgggaggagaactgagatcacatgcgcagcttgtggggggcatctgggtcatgtattcaagggcgagggtcacaagactccaacagacgaacgccattgtgtcaacagcatctctatcaagtttgtttcttctcagtga

SEQ ID NO: 84 - protein, 133 aa, Populus trichocarpa
MAGGGSVQKTEEEWRAVLSPEQFHILRDKGTEPKFSGEYDKFFEQGVFNCAGCGTPLYKSTTKFNSGCGWPAFYEGLPAAINRSPDPDGRRTEITCAACGGHLGHVFKGEGHKTPTDERHCVNSISIKFVSSQ

SEQ ID NO: 85 - DNA, 444 bp, Populus trichocarpa
atgggttcttctgcttcttcttctcagaagcctgacaacactcaaggagatgttaactatgcctctgtgagcgatggagaatggaagaagaagcttacagccgaggagttttacgtcactcggcagaaggggactgagagagctttctctggagagtattggaacaccaaaaccccgggaacttaccactgcatctgttgtaatacacctctatttgaatcatccactaaatttgacagaggaactggttggccatcttactatcagcccataggaaataatgtgaagtcaaagttagacttgtcgattattttcatgcctcgtcaggaagttctctgcgcggcttgtgatgctcatctagggcatgtatttgatgatggtccaccacctactggtaaacgttattgtatcaatagcgcttccttgaaactaaatcccaaataa

SEQ ID NO: 86 - protein, 147 aa, Populus trichocarpa
MGSSASSSQKPDNTQGDVNYASVSDGEWKKKLTAEEFYVTRQKGTERAFSGEYWNTKTPGTYHCICCNTPLFESSTKFDRGTGWPSYYQPIGNNVKSKLDLSIIFMPRQEVLCAACDAHLGHVFDDGPPPTGKRYCINSASLKLNPK

SEQ ID NO: 87 - DNA, 573 bp, Populus trichocarpa
atggcaacccacaccaccaatcctgctctggatccggatctagacaaaccagacaaccccaatcacgagtttgctcaattcggagctggatgtttctggggtgtcgagcttgcctttcagagattacatggtgtggtcaaaactgaagtaggctactctcagggtaacgtccctgatccgacttacaaacttgtatgcaccaaaaccaccaaccacgttgaggttgtccgggtccaatttgaccctgaagtttgcccatataccaacctcctctctcttttctggtctcgccatgatcccaccaccctcaatcgtcagggtggcgatgtgggtacacagtatagatcagggatatactactacaacgaggctcaagctaagttagcccaggaatcgaaggaagctaaacagttgggattgaaggataacacggttgtgacggaaatcctgccagcaaagagattttatagagctgaggagtaccatcagaagtatctggaaaaaggtgggggtcgaagcgctaaacagtctgctgaaaaaggttgcaatgaccctattagatgctatggttaa

SEQ ID NO: 88 - protein, 190 aa, Populus trichocarpa
MATHTTNPALDPDLDKPDNPNHEFAQFGAGCFWGVELAFQRLHGVVKTEVGYSQGNVPDPTYKLVCTKTTNHVEVVRVQFDPEVCPYTNLLSLFWSRHDPTTLNRQGGDVGTQYRSGIYYYNEAQAKLAQESKEAKQLGLKDNTVVTEILPAKRFYRAEEYHQKYLEKGGGRSAKQSAEKGCNDPIRCYG

SEQ ID NO: 89 - DNA, 573 bp, Populus trichocarpa
atggcaaccagcaccaccaatcctgctctggatccggatctagaccagccagacaacccgaatcacgagttcgctcaattcggagctggatgtttctggggggttgagcttgcctttcagagactgcctggtgtggtcaaaactgaagtgggctactctcagggtcacgtccctgacccaacttacaagctggtatgcaccaacaccaccaaccacgttgaagttgttcgtgtccaatttgacccggaagtttgcccatataccaacctcctctctcttttctggtctcgacatgatcctaccaccctcaatcgccagggtggtgatgttggtacacagtatagatcagggatttactactacaatgaggcccaagctaagttagcccaggaatcaaaggaagctaagcagttggaattgaaggatagcaaggttgtgacagaaattctgccagcaaagagatttttcagagctgaagagtaccatcagcagtatctggagaaaggtggaggtcaaggtgttaaacagtctgctgaaaaaggttgcaatgaccctattagatgctatggttaa

SEQ ID NO: 90 - protein, 190 aa, Populus trichocarpa
MATSTTNPALDPDLDQPDNPNHEFAQFGAGCFWGVELAFQRLPGVVKTEVGYSQGHVPDPTYKLVCTNTTNHVEVVRVQFDPEVCPYTNLLSLFWSRHDPTTLNRQGGDVGTQYRSGIYYYNEAQAKLAQESKEAKQLELKDSKVVTEILPAKRFFRAEEYHQQYLEKGGGQGVKQSAEKGCNDPIRCYG

SEQ ID NO: 91 - DNA, 795 bp, Populus trichocarpa
atgctccgaaatcttgctacccacttctcctctacctcctccaccaccaccagcagcagcaccacccctcttctcgtcctctcaaaacctttccgttctctctcatcaaaatcgctactttttctctctaaacccttcaatttccctcgaacctcaaaacccatctcttattacaagccatcaatgaacatccttaacaaactaggctttggtcccaggtcacctgacccatcaacaatggacccaacaatcccacaaggtcccgatgatgacttaccagctcctggtcagcaatttgctcagtttggagctggttgtttttggggtgttgaattagcatttcaaagagtccctggtgttactaaaactgaagtgggttatactcagggcttattgcataatccaacttatgaggatgtttgttccggcactactaatcataatgaagttgttagggttcagtatgaccctaaagagtgtagctttgacactttgcttgatgttttgtgggctagacatgaccctactgccttgaatcgccaggggaatgatgtgggaacacagtacaggtctggaatatactattacacccctgagcaggagaaagcagcgaaggagtccttggaacggcagcagaagctcttgaacaggaagatagtcactgagattttacctgccaaaaaattctacagagcagaagaataccaccagcagtatcttgcgaagggtggccgatttggatttatgcaatctgctgagaaaggatgcaatgatccaatcaaatgctatggctaa

SEQ ID NO: 92 - protein, 264 aa, Populus trichocarpa
MLRNLATHFSSTSSTTTSSSTTPLLVLSKPFRSLSSKSLLFLSKPFNFPRTSKPISYYKPSMNILNKLGFGPRSPDPSTMDPTIPQGPDDDLPAPGQQFAQFGAGCFWGVELAFQRVPGVTKTEVGYTQGLLHNPTYEDVCSGTTNHNEVVRVQYDPKECSFDTLLDVLWARHDPTALNRQGNDVGTQYRSGIYYYTPEQEKAAKESLERQQKLLNRKIVTEILPAKKFYRAEEYHQQYLAKGGRFGFMQSAEKGCNDPIKCYG

SEQ ID NO: 93 - DNA, 546 bp, Triticum aestivum
atgtcgagcaccggcgcggcgggcccggacgccgacgcggcggtcggtgaggggctggagctggcgcagttcggggcgggctgcttctggagcgtggagctggcgtaccagcggctccccggcgtggcgcgcacggaggtgggctactcgcaggggcacctcgacgggccgacctaccgcgacgtctgcggcggcggcaccggccacgccgaggtcgtgcgcgtgcactacgaccccaaggagtgcccctacgccgtgctcctcgacgtcttttgggccaagcacaaccccaccacgctcaacaagcagggcaacgacgtcgggacgcagtaccggtcgggcatctactactacacggcggagcaggagcggcaggcgcgggagtcgctggcggagaagcagcgggagtggaaggagaagatcgtgacggaggtcctcccggcgcggaggttctacccggccgaggactaccaccagcagtacctcgagaagggcggccagtccgccaagaagcgctgctccgaccccatccgctgctacggctga

SEQ ID NO: 94 - protein, 181 aa, Triticum aestivum
MSSTGAAGPDADAAVGEGLELAQFGAGCFWSVELAYQRLPGVARTEVGYSQGHLDGPTYRDVCGGGTGHAEVVRVHYDPKECPYAVLLDVFWAKHNPTTLNKQGNDVGTQYRSGIYYYTAEQERQARESLAEKQREWKEKIVTEVLPARRFYPAEDYHQQYLEKGGQSAKKRCSDPIRCYG

SEQ ID NO: 95 - DNA, 657 bp, Triticum aestivum
atgtcgagcaccggcgcgtcgggcccggacgccgacgcggcggccggcgaggggctggagctggcgcagttcggggcgggctgcttctggagcgtggagctggcgtaccagcggctccccggcgtggcgcgcaccgaggtgggctactcgcaggggcacctcgacgggcccacctaccgcgacgtgtgcggcggcggcaccggccacgccgaggtggtgcgcgtgcactacgaccccaaggagtgcccctacgccgtgcttctcgacgtcttctgggccaagcacaaccccaccacgctcaacaagcagggcaacgacgtcgggacgcagtaccggtcgggcatctactactacacggcggagcaggagcggcaggcgcgggagtcgctggcggagaagcagcgggagtggaaggagaagatcgtgacggaggtcctcccggcgaggaggttctacgcggccgaggactaccaccagcagtacctccataagggcggccagtcccgccaagaaaggggtggtcccgaaccccaatccgggtgcttacgggttggtaaactcactggcccccgcgtcccccggaccggccctaaggcttatgggatggctggcattggccccgtcaagccctcctttaaaggggacacccgttcctaa

SEQ ID NO: 96 - protein, 218 aa, Triticum aestivum
MSSTGASGPDADAAAGEGLELAQFGAGCFWSVELAYQRLPGVARTEVGYSQGHLDGPTYRDVCGGGTGHAEVVRVHYDPKECPYAVLLDVFWAKHNPTTLNKQGNDVGTQYRSGIYYYTAEQERQARESLAEKQREWKEKIVTEVLPARRFYAAEDYHQQYLHKGGQSRQERGGPEPQSGCLRVGKLTGPRVPRTGPKAYGMAGIGPVKPSFKGDTRS

SEQ ID NO: 97 - DNA, 792 bp, Triticum aestivum
atgcctcccctcctcacctcacccgcctccctctcctcctcccccctccgcctcgcctcccgcctcgtcggcgccgccctccgtcccaccccctcctcctcgtcccgcagccgtcgtttcctcgcccccacccaaaccgcggcgccgggaaccaccaccagcggcgggttcgcggcgatgagctggctcgggaagctggggctgggcggcgggggaagcccgcgcgcgtcggaggcgtccgcggcgctggcgcaggggcccgacgaggacaagccggcgcccgggagcgagttcgcgcagttcggggccggctgcttctggggcgtggagctggtgttccagcgcgtgcccggggtcacccgcaccgaggtcggctacagccagggcgccttccacgaccccacctacgaggacgtctgcaccggcgccaccggccacaacgaggtcgttcgcgtccagtacgaccccgccgcctgcaagtacgacgacctcctcgaaaccttctgggcgcgccacgacccgaccacgcccaatcgccaggggggcgacgtcggaacccagtacaggtcagggatctactactacacatcagagcaggagaaggcggcgctcgagtctatggagaagcagcagaaggttcagaaccggaagatagtcactgagatcctccccgcgaagaggttctacaaggcggaggagtaccaccagcagtaccttgcgaagggcggtcgctttggcttcaaacagtccacggagaagggctgcaacgaccccatccgctgctacggatga

SEQ ID NO: 98 - protein, 263 aa, Triticum aestivum
MPPLLTSPASLSSSPLRLASRLVGAALRPTPSSSSRSRRFLAPTQTAAPGTTTSGGFAAMSWLGKLGLGGGGSPRASEASAALAQGPDEDKPAPGSEFAQFGAGCFWGVELVFQRVPGVTRTEVGYSQGAFHDPTYEDVCTGATGHNEVVRVQYDPAACKYDDLLETFWARHDPTTPNRQGGDVGTQYRSGIYYYTSEQEKAALESMEKQQKVQNRKIVTEILPAKRFYKAEEYHQQYLAKGGRFGFKQSTEKGCNDPIRCYG

SEQ ID NO: 99 - DNA, 777 bp, Zea mays
atggcagccccctccgcggccgtcataggggtgctcgtcctcctcgtcgtgggggcctcgggcgcgcgcctcccaggccgcggcagcaccacccggggagctgcgctgccgcgcgggggagcgccggccacggcggtgttcgcgctgggaagcttctggcggtcggaggcggcgttcgggtgcctccacggcgtgatccgcacctccgtcggctacgctggcggctccaagtccaaccccgagtaccgcaacctcgccgaccacgccgagtgcgtcaaggttgagtatgatccccggttgattcactacaggcaacttttggatgtgttctgggcaagtcatgacccacgtgaggtgtttgggcaagggccagatgttggcaaccagtatagatctgtcatcttcactaatggaaccatcgaggccagattggctggtcttagcaaagaaaaagaacaagctaaagaccgtagcagcgttgttaccacacagatccaaccattgggggtctttcatcatgctgaaccagaacatcagaaatttgaactgaagcgtaaaccgttcctcttgcaattgattgggaatttgccggaggaggagctcctgacatcaacactagctgcaaaactgaatgcatatgccgctgagctctgccctgcgaatacccaaaagagaattaactccaagattgatgaagtcacaaagaaaggatggcccattttaagggacatttaactctttctagcttttggactcaaaccgatcgatgcaatgtag

SEQ ID NO: 100 - protein, 244 aa, Zea mays
MAAPSAAVIGVLVLLVVGASGARLPGRGSTTRGAALPRGGAPATAVFALGSFWRSEAAFGCLHGVIRTSVGYAGGSKSNPEYRNLADHAECVKVEYDPRLIHYRQLLDVFWASHDPREVFGQGPDVGNQYRSVIFTNGTIEARLAGLSKEKEQAKDRSSVVTTQIQPLGVFHHAEPEHQKFELKRKPFLLQLIGNLPEEELLTSTLAAKLNAYAAELCPANTQKRINSKIDEVTKKGWPILRDI

SEQ ID NO: 101 - DNA, 653 bp, Medicago truncatula
agttcgagcctatcagctgctgcacaaattcttcccaatacccaaattcagaaatttgattccaaacttttgttgtggccatcacgtttgcatactaaacccacaacaaaactttcttcttcaattcgggcaatgggctcttcagcttcttctaactccaacaacccaaacaccacagaaattcaatcaggatctagtcctgttgattataaatctttaagtgatgcagaatggaagaagcagctaaccgatgaacaattttatgttactcggaaaaagggaactgagagagctttcaccggggagtactggaataccaaaactgaagggacttaccattgcatatgttgtgacacacccttatttgaatcatctaccaagtttaatagtggaactggttggccatcttattaccagccaattggtaaaaatgtgaaatcaaagctagatttgtcaattatattcatgcctcgccaagaagttctctgtgctgtttgtgatgctcatctcggacacatttttgatgatggccctccacccacaggaaagcgttactgtatcaacagtgcttcccttaaactcaaaccaaggaagtaagatgatcaaatacttgtcactcaaatgtagatggtttaatattcaaatggtaactg

SEQ ID NO: 102 - protein, 154 aa, Medicago truncatula
MGSSASSNSNNPNTTEIQSGSSPVDYKSLSDAEWKKQLTDEQFYVTRKKGTERAFTGEYWNTKTEGTYHCICCDTPLFESSTKFNSGTGWPSYYQPIGKNVKSKLDLSIIFMPRQEVLCAVCDAHLGHIFDDGPPPTGKRYCINSASLKLKPRK

SEQ ID NO: 103 - DNA, 898 bp, Arabidopsis thaliana
actcacaaaattaattcttcttctcttttcttttcttaaaagagctcaaaacacacgaccatctttccgctgtcttcttagcttcttatctaccgtaatcatgccaacatcagcaacagcggtggctccatcaactggatctgtccagaaaaaagatcaagactggcgtgcgattttgtctcccgagcaatttagagttctcagggaaaagggcacagagaaccgaggtaaaggagagtataccaaactgttcgacgacggaatctatagttgtgctggttgtgcaactcctctttataagtccaccactaagttcgactctggttgtggctggccttccttcttcgatgctatccctggtgccattaaacaaacggtaattgacatattctttttcttttcttttatgacacacaattattttagtgataaagattgttgtattaaacaagttttatgtttataaaatatctctatcagcccgaggcaggagggagaagaatggagatcacgtgcgcggcatgtgacggacatttaggtcatgttgtcaaaggagaaggttttcccacagcgaccgatgagcgccactgcgtcaacagtgtttctctcaagttctctgaaatttcctcccaataagtctatatagtccacattgatgaccactattgttggaccaagtcctctccttcaagaaaatttgaaaatcaagtcggattgtttgagattgtcatgttatgttccattcctagtcttgtgtgatatgctcgctccagtgattgttgtttgtcccttgtatggatatctttttaataattatattattgttatctttccattgacccttgatatgttcaatgcaagtcctatataataaaaattggcatttgttttctcattt

SEQ ID NO: 104 - protein, 121 aa, Arabidopsis thaliana
MPTSATAVAPSTGSVQKKDQDWRAILSPEQFRVLREKGTENRGKGEYTKLFDDGIYSCAGCATPLYKSTTKFDSGCGWPSFFDAIPGAIKQTVIDIFFFFSFMTHNYFSDKDCCIKQVLCL

SEQ ID NO: 105 - DNA, 893 bp, Arabidopsis thaliana
gagagtcagaaaaagctgttgtcaagagaagaaggaagagaggagataaaaagccaaacaaatggcgttcaatatcataacacctggtcgtgtttattcagccacgtctctcactttcgtttccaccattaaagctgctttcgttaaacctcctttggcctctccgtctcgtcgtaacctccttcgtttctcatcatctcctttgtcatttccgtcgctccgtcgaggtttccacggtggtcgtattgtggcaatgggttcttctgctcctgaatcggtcaataagccggaagaagagtggcgtgcgattctttctcctgaacaatttaggattctcagacagaaaggcactgaatatccaggaactggagaatacaacaaagtattcgacgatggcatctattgttgtgcaggatgtggaactcctctctacaaatccaccaccaaattcgactctggttgtggctggccagctttctttgatggactccccggagctataacccgaaccatgggagacgaatcgagatcacatgtgctgcttgtggaggacatcttggtcacgtttttaaaggagaaggtttccctactcctaccgatgagcgacactgtgtaaacagtatctctctcaagttcacaccagagaatccgaccctgtaataatatgatcacagaaaaaaagacgtgataatataggtgtgttgtgtgatgcttctgtctctctctcgtactgtgtttttgtcttttttctgtgagactaatgtttacttttgatggttaataataaggtcgttgaataaagtctccagactttttgtatcgtcatggcagatttttctcaggctggtaaagttaatagtgttactagtttgcagagaaaaataaaatgattt

SEQ ID NO: 106 - protein, 184 aa, Arabidopsis thaliana
MAFNIITPGRVYSATSLTFVSTIKAAFVKPPLASPSRRNLLRFSSSPLSFPSLRRGFHGGRIVAMGSSAPESVNKPEEEWRAILSPEQFRILRQKGTEYPGTGEYNKVFDDGIYCCAGCGTPLYKSTTKFDSGCGWPAFFDGLPGAITRTMGDESRSHVLLVEDILVTFLKEKVSLLLPMSDTV

SEQ ID NO: 107 - DNA, 773 bp, Brassica napus
atcatcatcttcagccaccaccatcagagccttcgttagaccttctctctccctcagaatcactcgtttcgcgaatcctaacctccttcctctctccgcctctccttcctcatttcctccgctccgtcttcttagccgaggcttccacggtggtcgtatcacagcaatgtcttctcctgctcccggatcggtcaacaagccagaggaagagtggcgtgcgatcctgtctcctgagcaattcaggatcctgaggcagaaaggcaccgaatatccaggaacaggagaatacaacaaactattcgaagacggcatctattcttgtgcaggatgtgggactcctctttacaaatccgccaccaaattcgactccggttgtggctggcctgctttctttgacggccttcccggtgctataaaccgaactcctgatccagatgggagaagaatcgagatcacttgtgcggcttgtgggggacatctcggccatgttttcaaaggagaaggtttccctacacctaccgatgagcgacactgtgtgaatagtatctctctcaagttcgcaccagggaatcaagacttgtaataatgtactttgtgttgtgtaatgcttctgtctatttcttgtgtgtcttgctcgttgtaaccagtgttcagttccactaatgtcgttcaatcaaaagtcttgagactcttggtattgtcataatcatacataagattttacacaaaccggcgaataaagtaacttcacttcgaaaaaaaaaaaaaaaaaa

SEQ ID NO: 108 - protein, 138 aa, Brassica napus
MSSPAPGSVNKPEEEWRAILSPEQFRILRQKGTEYPGTGEYNKLFEDGIYSCAGCGTPLYKSATKFDSGCGWPAFFDGLPGAINRTPDPDGRRIEITCAACGGHLGHVFKGEGFPTPTDERHCVNSISLKFAPGNQDL

SEQ ID NO: 109 - DNA, 840 bp, Brassica napus
ggtcgacgattccgtagaagacatcagaacacacgaccatctctctgtcgccttaaaagcctcttcttaccatggcaacgacagcaacatcggcggctccatcacctggatctgttcagaaacacgatgaggagtggcgtgcggttctgtctcctgaacaatttagagttctcaggaaaaagggaacagaagcccgattcaaaggagaatatacaaaactgttcgaggaaggaacctatgcgtgtgctggctgtgcgactcctctttataagtccaccaccaagttcgactctggttgtggctggcctgccttcttcgacgctattcctggtgccattatacaaactctggagccagatgggaagagagttgagatcacatgcgcaaaatgtgatggacatttaggtcatgttttcaaaggagaaggattccccacggctaccgatgagcgtcactgcgtcaacagtgtttctcttaagtttaattcttccgaaacttcctcctgataaatcgatatatatccatttattgtttggaccaattcttctcctacaagagaataaaaaaattgagtctagtcgtttaacgaacaacttatgcaagatggaacaaaaaatgtgggattagaaagtcatagcttcaggtataaatattgatgaattcagatgatccgagcaagaagaaagagcaactaagggaacccaagagagcagcgtagagaagttaattagtgtaatttatcgtgtgttgagattcaagtcttgttcttaggtttttttactctagtttctgtattgtacctaaacacaagagtgaccaagttaaagtttgtgtaatcct

SEQ ID NO: 110 - protein, 144 aa, Brassica napus
MATTATSAAPSPGSVQKHDEEWRAVLSPEQFRVLRKKGTEARFKGEYTKLFEEGTYACAGCATPLYKSTTKFDSGCGWPAFFDAIPGAIIQTLEPDGKRVEITCAKCDGHLGHVFKGEGFPTATDERHCVNSVSLKFNSSETSS

SEQ ID NO: 111 - DNA, 886 bp, Brassica napus
gatggcgttgaacgtgatacagtcatctgtgcgtgtatcttcagccacttctttgaccttctcttccgccatcaaatccttcgtcacaccttccctccccctcgcaacccatcgattctctctttctccctcgccgaatctcaacctccttcgcatcccctcctctccaccgtccttctcatcgctccgccgaggttttcgcggtggtcgtataacagcaatggcttcttctgctcccggatcggtcaacaagccagaggaagagtggcgtgcggttctctctcccgagcaattcagaatcctcaggcagaaaggcactgaatatccagggacaggggagtacaacaaagtattcgcagacgggatctatagctgtgcaggatgtgaaactcctctatacaaatccgccaccaagttcgactctggctgtggctggcctgctttctttgacggcatccccggcgccataaaccgaaccgcggatccagatgggagaagaatagagatcacgtgtgcagcgtgtggaggacatctggggcatgttttcaaaggagaaggtttccctactcctaccgatgagcgacattgtgtcaacagtgtctccctcaagttcgcacccgggaacgcagccttgtaataataatctacttgtattgtgcgtcaaaaaaaagatagtgtgtgttgcttatttgtgtcccacccgctggctcgcactgtgtttcgatgtgactgctagtagtaataaggtggttgaattaacgtaaaaaaaaaaaaaaaaaaaaaaaaaaaaaaaaaaaaaaaaaaaaaaaatcggggcccttttataaaacacatttttatgcccggcgggcggagataatatttttttttatgggggcccaaaaat

SEQ ID NO: 112 - protein, 211 aa, Brassica napus
MALNVIQSSVRVSSATSLTFSSAIKSFVTPSLPLATHRFSLSPSPNLNLLRIPSSPPSFSSLRRGFRGGRITAMASSAPGSVNKPEEEWRAVLSPEQFRILRQKGTEYPGTGEYNKVFADGIYSCAGCETPLYKSATKFDSGCGWPAFFDGIPGAINRTADPDGRRIEITCAACGGHLGHVFKGEGFPTPTDERHCVNSVSLKFAPGNAAL

SEQ ID NO: 113 - DNA, 867 bp, Brassica napus
tcgacgattccgtccttctgtaacatcctccatttcgtggatgtcatagaagaagacttcaaaatcgaaacagtattcaaagaaagatggcttcttctagttgtttcaccattcaatcaagcttcttctcagcgagtacaaggctcgattcaatctccaaaccgagtctctccggattcgcttgtcgttctcttacaaaacccagaaacttgaatctctctgttcttcttcgttgttccatgggttcctttaactcttctcagaaatcagacaacgtccaagaagctgcaaagagtgactttgcttcaataagtgaaggtgagtggaagaaacggcttacaccggaacagtattacatcactagacagaaggggacagagagagctttcactggtgagtattggaatacaaagaccccaggagtatacaaatgtatctgttgcgacacgccactgtttgactcatcaacaaagtttgatagtggaaccgggtggccatcgtattaccaacctattggaaacaatgtgaagtcaaagctggacctctctatcatcttcatgcctagacaagaagttatctgtgctgtttgtaacgcccatcttggtcatgtcttcgatgacggtccacgaccaaccggaaaacgatattgcctcaacagtgctgctctgaaacttgagtcattggagagaacaagagaatgagagtttctggtacaaaggattattcatgtattatataatatagtttcgttttactatggtcctccttgtattgatgaaaacattgtaatcacatgtaataaatacacaggagaacagaacagttataagctttttgagttgactccacaaaaaaaaaaaaaaaaaa

SEQ ID NO: 114 - protein, 204 aa, Brassica napus
MASSSCFTIQSSFFSASTRLDSISKPSLSGFACRSLTKPRNLNLSVLLRCSMGSFNSSQKSDNVQEAAKSDFASISEGEWKKRLTPEQYYITRQKGTERAFTGEYWNTKTPGVYKCICCDTPLFDSSTKFDSGTGWPSYYQPIGNNVKSKLDLSIIFMPRQEVICAVCNAHLGHVFDDGPRPTGKRYCLNSAALKLESLERTRE

SEQ ID NO: 115 - DNA, 649 bp, Brassica napus
tgatcaagaacctagaagaacaatatcattatctgattcggttcctccgtcgtaatatctcagcttcaggttatcttaagtggcggtgatggcggcagctcatggacgggtggttcagaaaacagaggaggagtggcgtgcgatcctttctcctgagcagtttaggatcctccgacaaaaaggcactgaaataccaggaaccggagaatatgacaaattcttcgaggatggaattttcagctgtgtcggatgcaaaactcctctctataaatctactacaaagtttgactccggatgtggttggccagctttctttgaaggactccctggtgccattaaccgagcgcctgatccagatgggaggagtacagagatcacttgtgcagtatgcgacgggcatttaggccatgttacaaaaggagaaggttatgatactcctaccgatgaacgccactgcgttaacagcgtctcgatcatcttcaacccgcaaaaaccacctgaggaggctgaggattgatcataaaatatagtcaatcagattgactgtgttgtttaataaattctccggtttgctcatcaagtgaaagaaatcagaaataataatgttgaatcatctttgtcaaaagaagaataataataacagggatca

SEQ ID NO: 116 - protein, 142 aa, Brassica napus
MAAAHGRVVQKTEEEWRAILSPEQFRILRQKGTEIPGTGEYDKFFEDGIFSCVGCKTPLYKSTTKFDSGCGWPAFFEGLPGAINRAPDPDGRSTEITCAVCDGHLGHVTKGEGYDTPTDERHCVNSVSIIFNPQKPPEEAED

SEQ ID NO: 117 - DNA, 720 bp, Glycine max
  misc_feature (676)..(676): n is a, c, g, or t
tgattcgtgaacacaaacaccatcgccatgggcttcaatattctgagaaccacttccatctccactcctatctcttcctccaaatccaaacccattttctcaactcttcttcgttcttctccttccaccattttccccccaaagtccgttactcccaccactcttttcgtttctgccacccccttcttcactctccatcccaagcttggttttcgtggtgggattgtggccatggccgcacctggctctctccgcaaatccgaggaagagtggcgcgcaattctctcccctgaacagtttcggatcctcaggcaaaagggcaccgagttccctggaacaggagagtatgacaagttctatgaagagggagtttacaactgtgctggttgtgggactccactctacaggtccataacaaaattcaattctggttgtggctggccagccttctatgaggggattcccggagccataaatcgcaatccggatcctgatgggatgaggacagaaataacgtgtgctgcttgtgggggacatctaggtcacgtctttaaaggagaaggatttccaacacccactaacgaacgccattgtgtcaatagcatttcgctgaaatttgcgccagccaattcttattcttaataaaattgagtctgctggttgacgtgactacttnagtacccaacatcggtaaaaaaattatgcaatgtacttatatta

SEQ ID NO: 118 - protein, 204 aa, Glycine max
MGFNILRTTSISTPISSSKSKPIFSTLLRSSPSTIFPPKSVTPTTLFVSATPFFTLHPKLGFRGGIVAMAAPGSLRKSEEEWRAILSPEQFRILRQKGTEFPGTGEYDKFYEEGVYNCAGCGTPLYRSITKFNSGCGWPAFYEGIPGAINRNPDPDGMRTEITCAACGGHLGHVFKGEGFPTPTNERHCVNSISLKFAPANSYS

SEQ ID NO: 119 - DNA, 1348 bp, Glycine max
ccggctggacgatgtcgttttctcttcaatactactctcaactcattcttctctctcaaaaaccattagaaacgaaaataaccaaataagaagaaagaaacaatgaacgacttgttctccggttccttctcccgcttccgcagcgaccagtcctccccggaccgccaccacgacatcgagatgggcgccaccgcctccagcggcggtcgcggcggcgaggtgaaccttgacaagttcttcgaggacgtggaaggcgtgaaggaggaactaaaggagttggaaggtttggctcagagtctaaggagcagccacgagcagagcaagacgctgcacaacgcgaaggcggtgagggacctgcgcgcgggcatggacggcgacgtctcggcggcgctgaagaaggcgaagctgatcaagctcaagctcgaggcgctggagcggtccaatgccgcgaaccgtaacttgcctggatgtggaccgggttcgtcctcggaccggacccggacctccgtggtcaacggtttgaagaagaagctgaaggattcgatggagagtttcaacgagattcgcgggcttgtttcgtcggagtaccgcgagaccgtgcagcggcggtacttcaccgtcaccggcgagaatcccgatgataagacgctcgatctcttgatctccaccgtgtggagcatctgggaaaaaatggcagcaccaacgccgattcacaaaactgaagaggaatggaaggtcattctctcccccgagcagtttcggatccttcgccagaaaggaactgaattgaagggtacaggagaatataacaagttttttgaagaaggaatttacaactgtgctggctgtgggactcctctttacaagtcttcaaccaagtttgattctggttgtggttggcctgctttctttgagggttttcccggcgccatcaatcgaacccctgacccagatgggaggaggactgagataacctgtgcagcctgtggtgggcacttgggtcatgttttcaaaggagagggattcaagaccccaactgatgaacgccattgcgtcaatagtatttctgtcaaatttgttccgggaagtgctactttttcaatatgaaaccttacttgctctattggaggtgtctattgaaagattgtcttgtttgtggtcttttacagacagctagctagctagctctcaagaataaaatcgttttcttgtttaaaaaaaaaaaaaaaaaagaaaaaaagaaaaaaaaaaaaaaaaaaaaaaaaaaagagagagaagagaaaaaaaaaaggagaggaaaaaaaaaaaaaaaaaacttgaaggggggcccgcagcccaattgcccctt

SEQ ID NO: 120 - protein, 334 aa, Glycine max
MNDLFSGSFSRFRSDQSSPDRHHDIEMGATASSGGRGGEVNLDKFFEDVEGVKEELKELEGLAQSLRSSHEQSKTLHNAKAVRDLRAGMDGDVSAALKKAKLIKLKLEALERSNAANRNLPGCGPGSSSDRTRTSVVNGLKKKLKDSMESFNEIRGLVSSEYRETVQRRYFTVTGENPDDKTLDLLISTVWSIWEKMAAPTPIHKTEEEWKVILSPEQFRILRQKGTELKGTGEYNKFFEEGIYNCAGCGTPLYKSSTKFDSGCGWPAFFEGFPGAINRTPDPDGRRTEITCAACGGHLGHVFKGEGFKTPTDERHCVNSISVKFVPGSATFSI

SEQ ID NO: 121 - DNA, 774 bp, Glycine max
gcacgagacacaatacagggcagcatcgccatgggattgagtattctgagaagcacttccatttccactcctatctcttcctccaaatccaaacccattttctcaactcttgttcgttcatctttcgcctccatttcccccacaaagtgtgttactcccaccactcttttcgtttctgccacccccttcttcaccgcctcacccaagcgcggctttcgtggtgggattgtggccatggccgccgctggctcgctccgcaaatcagaggaagagtggcgcgcagttctctcccctgaacagtttcgtattctcaggcaaaagggcaccgagttccctggaacaggagagtatgacaagttctttgatgagggagtttacaactgtgctggttgtgggacacctctctacaggtccttaacaaaattcaattctggttgtggctggccagccttctatgaggggattcctggagccataaatcgcaatccggaccctgatgggatgaggacagaaataacgtgtgctgcttgtgggggacatctaggtcacgtctttaaaggagaaggatttccaacgcccactaacgaacgccattgtgtcaatagcatttcactgaaatttgcgccagccaattcttaataaaaattgagtctgctgttcggacgtgactgcttaagtacccaacattagtaaaaaaaaattatgcaatgtacttatattatgaatgaagttcatataatgatggctaaataccaattttaattaaagagttat

SEQ ID NO: 122 - protein, 202 aa, Glycine max
MGLSILRSTSISTPISSSKSKPIFSTLVRSSFASISPTKCVTPTTLFVSATPFFTASPKRGFRGGIVAMAAAGSLRKSEEEWRAVLSPEQFRILRQKGTEFPGTGEYDKFFDEGVYNCAGCGTPLYRSLTKFNSGCGWPAFYEGIPGAINRNPDPDGMRTEITCAACGGHLGHVFKGEGFPTPTNERHCVNSISLKFAPANS

SEQ ID NO: 123 - DNA, 799 bp, Glycine max
cacgagatggcttctcaaagtttgagtttaccaccaacacatattccttacaataggataattgggaagcttgattccaagtttttgttgtggccttcttgtgctcatatcaaacccagaagaatttctacctcaattcgggcaatgggttcctccgcttcttcccactcccagtcacaatatgcagacagcgttgaatctgaagcaggagctgatactattgactataaatctttaaccgatgaagagtggaagaagcggctcacaaatgaacagttctatattactcgtcagaagggaactgaaagagctttcactggggagtactggaatactaaaaccccggggatttaccattgcatatgttgcgacacacctttattcgaatcatctactaagttcaatagtggaactgggtggccatcctattaccagacaattgggaaaaatgtgaaatcaaagttggatttgtcaattattttcatgccgcgccaggaggttctctgtgctgtttgtgatgctcatcttggacatgtgtttgacgatggtcctccacccacgggaaaacgtttctgtatcaatagtgctgcccttaagctcaaaccaaagcagtagacagtgaaatacctacctatcactcggaagcagatggtataatattttaaatatgtgatatactttgggctgtttttcctatttatggagaaccacaatgaatattgtcctgaactgttgatgtataaaacccaaattttataaaatttagaagctccattttaaaaaaaaaaaagaaaaaaaa

SEQ ID NO: 124 - protein, 202 aa, Glycine max
MASQSLSLPPTHIPYNRIIGKLDSKFLLWPSCAHIKPRRISTSIRAMGSSASSHSQSQYADSVESEAGADTIDYKSLTDEEWKKRLTNEQFYITRQKGTERAFTGEYWNTKTPGIYHCICCDTPLFESSTKFNSGTGWPSYYQTIGKNVKSKLDLSIIFMPRQEVLCAVCDAHLGHVFDDGPPPTGKRFCINSAALKLKPKQ

SEQ ID NO: 125 - DNA, 629 bp, Glycine max
  misc_feature (629)..(629): n is a, c, g, or t
gccattttctcaactcttgttcgttcatctttcgcctccatttcccccacaaagtgtgttactcccaccactcttttcgtttctgccacccccttcttcaccgcctcacccaagctcggctttcgtggtgggattgtggccatggccgccgctggctcgctccgcaaatcaaaggaagagtggcgcgcagttctctcccctgaacagtttcgtattctcaggcaaaagggcaccgagttccctggaacaggagagtatgacaagttctttgatgagggagtttacaactgtgctggttgtgggacacctctctacaggtccttaacaaaattcaattctggttgtggctggccagccttctatgaggggattcctggagccataaatcgcaatccggaccctgatgggatgaggacagaaataacgtgtgctgctagtggaggacatctatgtcacgtctttatagtgagaggattctcacgcccactaacgaacgccattgtgttatagcatttcactgaaatgtgcgctatccagtgctaaataaaaattgagactgctgttcggacgtaactgtttggagtctctatcttactctgcaaacacatttgcgcggtcctctattttcn

SEQ ID NO: 126 - protein, 122 aa, Glycine max
MAAAGSLRKSKEEWRAVLSPEQFRILRQKGTEFPGTGEYDKFFDEGVYNCAGCGTPLYRSLTKFNSGCGWPAFYEGIPGAINRNPDPDGMRTEITCAASGGHLCHVFIVRGFSRPLTNAIVL

SEQ ID NO: 127 - DNA, 792 bp, Hordeum vulgare
  misc_feature (633)..(633): n is a, c, g, or t
  misc_feature (655)..(655): n is a, c, g, or t
gctaccttggtctcgtcccgagcgcacctgtcctcctacctcccgcccctcctcccctccgcgcgaccccgatccacgacaacccgcagctgcggcggcagcagttacaggcggaccgccgttcgcgccatgggcgccgcgccgtcgtcgccctcgccgtccggacaagccccagggaaagtggataacgcatctctgagtgatgaggagttgaagaagcgcctcacaaaagaacagtattatgtcactcggcagaagggaactgagagggcattcacaggggaatactggaacactaaaaccccaggcgtctaccactgcatctgctgtgacacccctctgttggagtcatctaccaagtttgatagtggtactggatggccgtcctattatcagccggttggcgacaatgtgaaaagcaagcttgatatgtcaatcttcttcatgcctcggaccgagtccctgtgcgctgtctgcgacgctcatctcgggcatgttttcgacgacgggccaccgccgacgggaaagagatattgcatcaacagcgcttctcttaagtttaagccccagtagtcccctggaggaagaatcaagatgaaagcaccagccgcgccggcatgcaaaattttcggntttgggtattgaactatttttnccagtgtagagtctggtagtaaacctagttcccggcccggttttggcacatggtaaaacctgggatatttttttcaagggttggtaaaagccccttttgtccccaaaacaattttgggatggttccttcccaaaaaa

SEQ ID NO: 128 - protein, 147 aa, Hordeum vulgare
MGAAPSSPSPSGQAPGKVDNASLSDEELKKRLTKEQYYVTRQKGTERAFTGEYWNTKTPGVYHCICCDTPLLESSTKFDSGTGWPSYYQPVGDNVKSKLDMSIFFMPRTESLCAVCDAHLGHVFDDGPPPTGKRYCINSASLKFKPQ

SEQ ID NO: 129 - DNA, 729 bp, Hordeum vulgare
  misc_feature (702)..(702): n is a, c, g, or t
  misc_feature (709)..(709): n is a, c, g, or t
gtttcccagcgtccgcgccgcaaaagaagaacactactactacgaccatcgatggccgtccggtgtcacgctgctgctaccttggtctcgtcccgagcgcacctgtcctcctacctcccgcccctcctcccctccgcgcgaccccgatccacgacaacccgcagctgcggcggcagcagttacaggcggaccgccgttcgcgccatgggcgccgcgccgtcgtcgccctcgccgtccggacaagccccagggaaagtggataacgcatctctgagtgatgaggagttgaagaagcgcctcacaaaagaacagtattatgtcactcggcagaagggaactgagagggcattcacaggggaatactggaacactaaaaccccaggcgtctaccactgcatctgctgtgacacccctctgtttgagtcatctaccaagtttgatagtggtactggatggccgtcctattatcagccggttggcgacaatgtgaaaagcaagcttgatatgtcaatcttcttcatgcctcggaccgagtccctgtgcgctgtctgcgacgctcatctcgggcatgttttcgacgacgggcctccgccgacgggaaagagatattgcatgcaacagcgcttctctgaagtttaagccccagtagtccctggaagaagaatcaagatgaaaagcaccagcgcgccgcatgcaattttncgttttnggtatgaactatttccaggg

SEQ ID NO: 130 - protein, 195 aa, Hordeum vulgare
MAVRCHAAATLVSSRAHLSSYLPPLLPSARPRSTTTRSCGGSSYRRTAVRAMGAAPSSPSPSGQAPGKVDNASLSDEELKKRLTKEQYYVTRQKGTERAFTGEYWNTKTPGVYHCICCDTPLFESSTKFDSGTGWPSYYQPVGDNVKSKLDMSIFFMPRTESLCAVCDAHLGHVFDDGPPPTGKRYCMQQRFSEV

SEQ ID NO: 131 - DNA, 860 bp, Medicago truncatula
tgaacacaagatgatggtgaatatcctaaggataacacctctttcttctttcaacgtcaccaaacccatttcctcaattcgttctaaccctacctttctcttcaactctctccctaccatttccattcgtcaaccgaagcgtggttttcgcggtggaattgttgccatgtctgctgcacctactcctggctcggtccagaaatcggaggaagaatggcaagctattctctcccccgagcagtttcggattctcaggcagaaaggcactgagtaccctggaacaggagaatatgacaagttctttggggagggagtctacagttgtgcaggttgcgggactccactctacaagtcaacgacaaaattcaattccggttgtggctggccagccttctatgagggtgttcctggagccataaaccgccacgcggacccagatggaatgaggatagaaataacatgtgctgcttgtgggggacatctcggtcatgtatttaaaggtgaaggatttccgacacccacgaacgaacgccattgtgtcaatagcatttcactaaaatttgcgccagccaattcctagttatttacaatgaagtccactctgtggatacatgatgctcatggtccataaagaactataacagtactgaaattgggactgtggcttataaagttgtacctaaagtatgtagcttaaataaatgttaaaccagatgttcctttatttccctcctctcctgggggttgtattatgtatgttctcaagtgcctgtattgttcctgagactgttttggtatgaaaaagtttaatgccatagagtgtagttatgtttgaacctattaagctgtttttaataaat

SEQ ID NO: 132 - protein, 189 aa, Medicago truncatula
MMVNILRITPLSSFNVTKPISSIRSNPTFLFNSLPTISIRQPKRGFRGGIVAMSAAPTPGSVQKSEEEWQAILSPEQFRILRQKGTEYPGTGEYDKFFGEGVYSCAGCGTPLYKSTTKFNSGCGWPAFYEGVPGAINRHADPDGMRIEITCAACGGHLGHVFKGEGFPTPTNERHCVNSISLKFAPANS

SEQ ID NO: 133 - DNA, 883 bp, Medicago truncatula
gcaccaggtttttatttatttttattttatgatgaaacccctcatttggagaatggcatctcatagtttgagtttgagcctatcagctgctgcacaaattcttcccaatacccaaattcagaaatttgattccaaacttttgttgtggccatcacgtttgcatactaaacccacaacaaaactttcttcttcaattcgggcaatgggctcttcagcttcttctaactccaacaacccaaacaccacagaaattcaatcaggatctagtcctgttgattataaatctttaagtgatgcagaatggaagaagcagctaaccgatgaacaattttatgttactcggaaaaagggaactgagagagctttcaccggggagtactggaataccaaaactgaagggacttaccattgcatatgttgtgacacacccttatttgaatcatctaccaagtttaatagtggaactggttggccatcttattaccagccaattggtaaaaatgtgaaatcaaagctagatttgtcaattatattcatgcctcgccaagaagttctctgtgctgtttgtgatgctcatctcggacacatttttgatgatggccctccacccacaggaaagcgttactgtatcaacagtgcttcccttaaactcaaaccaaggaagtaagatgatcaaatacttgtcactcaaatgtagatggtttaatattcaaatggtaactgaaaaatttgtaaatggatcagtatatcgtatacttttttctgtttttctttacttgaagaaagaaactgtcccgtcctgatagtgtatccaaatttttataaatgtgaaaacttgttgattactgtacaataccctatataatgaagttttaagtaagaa

SEQ ID NO: 134 - protein, 212 aa, Medicago truncatula
MMKPLIWRMASHSLSLSLSAAAQILPNTQIQKFDSKLLLWPSRLHTKPTTKLSSSIRAMGSSASSNSNNPNTTEIQSGSSPVDYKSLSDAEWKKQLTDEQFYVTRKKGTERAFTGEYWNTKTEGTYHCICCDTPLFESSTKFNSGTGWPSYYQPIGKNVKSKLDLSIIFMPRQEVLCAVCDAHLGHIFDDGPPPTGKRYCINSASLKLKPRK

SEQ ID NO: 135 - DNA, 1120 bp, Physcomitrella patens
gtagaagcagtgtcgtcggggctggattgcagagctttgttggagagggcgcgaagagagagtcagcagggccagggagaagcgtgtttttgggagctcaggtgcagaagatgggagcgggtatgtccgcgcggtcggatgtgcgacctgcagcagttccgaaagcttcaggagatgtcagtgagcagactgactataaaacattcagtgatgaggaatggaagaagcgtctgtctcaacagcaattctacgtcgcacgcaagaaaggcaccgaaagacctttcactggagagtactggaacaccaaaacagcaggaacatacctatgcgtttgttgtaagacaccattgttcagctcaaagaccaagttcgacagtggtaccggatggccatcttactatgacaccataggtgacaatgtgaagtcacacatggattggtcgatacccttcatgccccgcactgaggttgtgtgtgctgtgtgcgatgctcatctgggtcatgtcttcgacgatgggccgaggcctactggcaaacgttattgtatcaacagcgcggcgattgatttgaaggccgagaagcaagaagagaggaactaggtacgtcaaggtataggaaaggaggaagctgagacaattcaaaataccaaagaatataccagtttcgctgtaatctgtactgggctatatctcttaaaagtgacatatggcatttttttcgaatgcttctgagtgtatacacacccttttaaaaatgacgtgagagcttgatttcaagtgtactgagtgacccttatcgtactaaggttgaagcttcagaattggaccccaagtattggagcagaattatagaattgtgttggtcgctgctacagcctgcatggaattggaaggacgatgtataatataaccgtacaagcatttctggagatgagaacggtagaaatcaaatcaaacctggcagagaaaaccatttattgggtcgtcatgtagctgaaaaagtttttttctaccaagtttttgtacttacgacgactaaatggtttcttttaggtagttcagcactcctcaccactttggcagtagacaggaactgcttacaaatacactgtatacaatat

SEQ ID NO: 136 - protein, 162 aa, Physcomitrella patens
MGAGMSARSDVRPAAVPKASGDVSEQTDYKTFSDEEWKKRLSQQQFYVARKKGTERPFTGEYWNTKTAGTYLCVCCKTPLFSSKTKFDSGTGWPSYYDTIGDNVKSHMDWSIPFMPRTEVVCAVCDAHLGHVFDDGPRPTGKRYCINSAAIDLKAEKQEERN

SEQ ID NO: 137 - DNA, 1280 bp, Physcomitrella patens
gatatgttccagatagttccgattggaggatccttcttgcatcgagggttttaaccgacgactctagtgtggtcacatggctgcaggattgatctggctggagaagatgagaggcgtaggtctatgggatgtgtcgaaaagtgggcgataaacttgtgggcttcgtaggtaggacctaatccgtttgtagggaagttgcgagtgctgcagcagcgtggcaaagtggaagtgagaccacgctgaggttgctcaaaggaagtgaggagaatgtgtaggcctctaacaatcagtctcgctatggcatccatgctctccaccgtagtcactaacaccaccatcgccaagcctgcctccgccgcgcgctccttcaaagctgcctccaacgccgcctccctgcggccttccgtcttcaaactcacgcacaacccaacgcttcgtttcgaagccaggcggggagtggctatggcgtcagctggaggagctgagacccaagtgcagaagtctgaggaagagtggagggccattctgagccccgagcaattccgtatcctgcgtcaaaagggcactgaatatcctggtaccggtgagtacaacaagaacaaagccgaaggagtgtataattgcgctggctgtggaactcctctttacaaatcaaccactaagttcgactccggctgtggatggccagcattctttgagggccttcctggtgctatcaatgagacgaccgatgcagatggccgtcgtgtggagattacctgcgcagcttgtggaggtcacctggggcatgttttcaggggcgagggtttccctactccaactgacgcacggcactgtgtcaatagcgtctcattgaagtttacaccagcaaacaagtcttgaatttgaaatgtggttcctctagagaaacgcagcgtcagcttgcatgttgaaatcgagagtgcacattgtattgcacaaggacaacaatactatctatctaatacagtaggttagaggtgtactgttaatgtataaaattgtaagcttctcgtgttcagttctttcttaaggaatgattagcaatcggttttaatgtaaaatctacagctctgtagtatcaaggagcctgatctgcattatatgcacatgttttaatcatttgaagaattaaaactcaatcgactgctcagtgagaacgtgttgctttacttgagtttgggtagtcatcaagatgatcacacatggagaagtattaattttctctgttttgtatctgtaataccccatgatgattcttc

SEQ ID NO: 138 - protein, 204 aa, Physcomitrella patens
MCRPLTISLAMASMLSTVVTNTTIAKPASAARSFKAASNAASLRPSVFKLTHNPTLRFEARRGVAMASAGGAETQVQKSEEEWRAILSPEQFRILRQKGTEYPGTGEYNKNKAEGVYNCAGCGTPLYKSTTKFDSGCGWPAFFEGLPGAINETTDADGRRVEITCAACGGHLGHVFRGEGFPTPTDARHCVNSVSLKFTPANKS

SEQ ID NO: 139 - DNA, 927 bp, Physcomitrella patens
gtcagccttgctgttgttgttgttgttgtagccacgctccacaccacgctccacaaccctgctctcgtcgcgtcgtgcttcctgagctgctgctgttgctgatctcgatcgtcttgcttttctaacttagccacaatcgtcgtcacgaatcctggtgaggagtggtcatggcatcagctgggggttctgggacgcaagtgcggaagtctgacgaggagtggagagctattttgagccccgagcaattccgaatcttgcgaaaaaagggaactgaataccctaattccggcgagtacaataagacctataacgacggtgtgtataattgtgctggctgtgaagcgcctctttacaaatccaccacaaagtttgactccggctgtggatggccagcattctttgaggggatccccggtgccatcaatgaaacacgtgatgcagatggtcgtcgtgtggagattacatgcgctgcctgtggaggtcacttgggccacgttttcaagggcgagggatttcctacccctacggatgccaggcactgtgttaacagtgtctcgttgaagtttacaccagcgaacatggcttagattacaggtgttcatttctattaaaacagctgttgaagaaacaaggttggaggtccagtgcttctgcacaaagctttacgtttcatatagatttgtctatcagaagactcaattgagcacttcactttatataaactatcactctctccgacacatatctatatctatatatatataattatgttagtaagaggagcatcactttcatcacaggcatcttcgtcaaccatttggaagtaaattcaatggttttcattctgtgtgggctcgcaagcttaagcatactagactgtaaactcctagcttgtccgagtgttgtacatttctattattattaccc

SEQ ID NO: 140 - protein, 139 aa, Physcomitrella patens
MASAGGSGTQVRKSDEEWRAILSPEQFRILRKKGTEYPNSGEYNKTYNDGVYNCAGCEAPLYKSTTKFDSGCGWPAFFEGIPGAINETRDADGRRVEITCAACGGHLGHVFKGEGFPTPTDARHCVNSVSLKFTPANMA

SEQ ID NO: 141 - DNA, 634 bp, Solanum lycopersicum
gtactccccaattcaggttttcatcatcatcatcatcatcaagtaagagagggttcagaggtggggttgttgctatggctgcaccagactccgttcacaagtcagaggaagactggcgtgcaattctatctcctgagcagttccgtattctaagacagaaaggcactgagtatccaggtaccggagagtatgacaagttttctggtgaaggagtctaccaatgtgcaggatgtagcactcctctctacaagtccacagcaaaattcaactcaggctgtggttggccagctttctttgagggtcttcctggagcaattaatcgcactcctgaccctgatggcaggagggttgagattacatgtgctgcttgtggtggacatcttggtcatgttttcaaaggagaaggtcacaacacacccacagatgaacgacactgtgtcaacagcgtttctgtcaagtttatccctgcaaatacctcatctgttctactctgaaaatggtgtcgttttcaccttaccttaagacttggcaaatggtagagggctgaagcaactgtttgtgaacatgtttatgtttagtcttgaatgaataatagagattcatagaaccgatagtaaactattcaagactgaag

SEQ ID NO: 142 - protein, 139 aa, Solanum lycopersicum
MAAPDSVHKSEEDWRAILSPEQFRILRQKGTEYPGTGEYDKFSGEGVYQCAGCSTPLYKSTAKFNSGCGWPAFFEGLPGAINRTPDPDGRRVEITCAACGGHLGHVFKGEGHNTPTDERHCVNSVSVKFIPANTSSVLL

SEQ ID NO: 143 - DNA, 749 bp, Solanum lycopersicum
gctcaggattgaactttttatcgaaaccccaattgggattaaacagcaagccaacttttggaggattcaaaagcaaaatttcagtctcaattcgtgcaatgggctcctcagcttcttcttccaaatccgatagtgttcaagggggcagtaaaatggattatagctctataagcgacgaggagtggaagaagaagcttacaaatgaacaattttatattacacggcaaaagggtacagaacgggcattcactggggagtactggaacagtaagacccctggaacatatcactgcatttgctgcgatactcctttatttgaatcttctaccaaatttgatagtggaaccggatggccatcgtactaccagcccatagacaacaatgtgaagtcaaagatggacttgtctatcattttcatgcctcgtcaagaagttctatgtgcagcttgcgatgctcatcttgggcatgtatttgatgatggccctccgcctactggaaagcgttactgcatcaatagcgcttccctgaaattgaagccaaagtagagctgtgctgtgtagaataccaaaggttattgattcctcaagaaatgcaagatatcaagctgcagaattattcatatgcacgaataatgttgcttctaaagtttcaatcgaactttgagagagtttcttctctgtgatgttgttaaagttcatatgttcacatatacataatatataagttggtcaaatgtactcatttttagc

SEQ ID NO: 144 - protein, 148 aa, Solanum lycopersicum
MGSSASSSKSDSVQGGSKMDYSSISDEEWKKKLTNEQFYITRQKGTERAFTGEYWNSKTPGTYHCICCDTPLFESSTKFDSGTGWPSYYQPIDNNVKSKMDLSIIFMPRQEVLCAACDAHLGHVFDDGPPPTGKRYCINSASLKLKPK

SEQ ID NO: 145 - DNA, 793 bp, Solanum lycopersicum
  misc_feature (19)..(19): n is a, c, g, or t
agttttaagcatatatccntggcttctcgaaccatacaaatctcctctttcagctcaggattgaactttttatcgaaaccccaattgggattaaacggcaagccaacttttggaggattcaaaagcaaaatttcagtctcaattcgtgcaatgggctcctcagcttcttcttccaaatccgatagtgttcaagggggcagtaaaatggattatagctctataagcgacgaggagtggaagaagaagcttacaaatgaacaattttatattacacggcaaaagggtacagaacgggcattcactggggagtactggaacagtaagacccctggaacatatcactgcatttgctgcgatactcctttatttgaatcttctaccaaatttgatagtggaaccggatggccatcgtactaccagcccatagacaacaatgtgaagtcaaagatggacttgtctatcattttcatgcctcgtcaagaagttctatgtgcagcttgcgatgctcatcttgggcatgtatttgatgatggccctccgcctactggaaagcgttactgcatcaatagcgcttccctgaaattgaaggcaaagtagagctgtgctgtgtagaataccaaaggttattgattcctcaagaaatgcaagatatcaagctgcagaattattcatatgcacgaataatgttgcttctaaagtttcaatcgaactttgagagagtttcttctctgtgatgttgttaaagttcatatgttcacatatacataatatataaagtggtcaaatgtactca

SEQ ID NO: 146 - protein, 148 aa, Solanum lycopersicum
MGSSASSSKSDSVQGGSKMDYSSISDEEWKKKLTNEQFYITRQKGTERAFTGEYWNSKTPGTYHCICCDTPLFESSTKFDSGTGWPSYYQPIDNNVKSKMDLSIIFMPRQEVLCAACDAHLGHVFDDGPPPTGKRYCINSASLKLKAK

SEQ ID NO: 147 - DNA, 730 bp, Solanum lycopersicum
tcaagatgggttctcatattctcaaaatctcaccttttgcttcgtcaacccctctgtttatcaacgccaccccattcttgagatttcaagccaaaaaggttgttagcatttgtggtcatcccaagacccaattcaggttttcatcatcatcatcatcatcaagtaagagagggttcagaggtggggttgttgctatggctgcaccagactccgttcacaagtcagaggaagactggcgtgcaattctatctcctgagcagttccgtattctaagacagaaaggcactgagtatccaggtaccggagagtatgacaagttttctggtgaaggagtctaccaatgtgcaggatgtagcactcctctctacaagtccacagcaaaattcaactcaggctgtggttggccagctttctttgagggtcttcctggagcaattaatcgcactcctgaccctgatggcaggagggttgagattacttgtgcagcttgtggcggtcatcttggtcatgttttcaagggtgagggtttccctaccccaacggatgaacgccattgtgtcaatagtgtttccctcaagtttacaccagcaaattcttagttcatcgcatttgggatgtgatggttatcatagctttatatctctcatgcatagtttatatgatgatatgttaactactgatggcagtgttgtgttttggaaataaaagttacttttagtcttgtgctttc

SEQ ID NO: 148 - protein, 197 aa, Solanum lycopersicum
MGSHILKISPFASSTPLFINATPFLRFQAKKVVSICGHPKTQFRFSSSSSSSSKRGFRGGVVAMAAPDSVHKSEEDWRAILSPEQFRILRQKGTEYPGTGEYDKFSGEGVYQCAGCSTPLYKSTAKFNSGCGWPAFFEGLPGAINRTPDPDGRRVEITCAACGGHLGHVFKGEGFPTPTDERHCVNSVSLKFTPANS

SEQ ID NO: 149 - DNA, 919 bp, Solanum lycopersicum
aacaatggcagttgagaaatctgaggaagaatggcgtgctattctatctcctgagcagtttcgaatcctccgtcagaaaggaactgagctaaagggaagtggtgaatatgacaagttttttgatgaaggaatttataactgtgctggttgtggaactccattgtataaatcctcaaccaaatttgactctggctgtggttggcctgctttctttgagggtcttccggggacgataaatcgctctccagatccagatggaaggaggacggagattacatgtgctgcttgtggtggacatcttggtcatgttttcaaaggagaaggtcacaacacacccacagatgaacgacactgtgtcaacagcgtttctgtcaagtttatccctgcaaatacctcatctgttctactctgaaaatggtgtcgttttcaccttaccttaagacttggcaaatggtagagggctgaagcaactgtttgtgaacatgtttatgtttagtcttgaatgaataatagagattcatagaaccgatagtaaactatttcaagactgaagtatttttgatttattgatatatatgttggtggctattcaaagtctataaacacaacctatatcaaccattgtggttcgagttaggaaccactcaacaaattgcttctttgggtacttctccttagctttgtaaaacttttgggtgctagatttattcactgcatacccgcgcatcaactttctttcctttctgtctttgggctgtttggttggcacgacataataaatatatcttcgagggaaaacctttcttagtaacatgtatgtcatgttactaagaaaccagtctgctaattctaacattatgcttattatggatagtggttgtgattcagtttcaagcttatttaccgcaaggggtgtttt

SEQ ID NO: 150 - protein, 135 aa, Solanum lycopersicum
MAVEKSEEEWRAILSPEQFRILRQKGTELKGSGEYDKFFDEGIYNCAGCGTPLYKSSTKFDSGCGWPAFFEGLPGTINRSPDPDGRRTEITCAACGGHLGHVFKGEGHNTPTDERHCVNSVSVKFIPANTSSVLL

SEQ ID NO: 151 - DNA, 579 bp, Solanum lycopersicum
tatcatttccatggactctcagattctaaaattttggccaattattccttcaaaaaatttaattttcaactccaaaaaagcagttcccattcgtggcctatccaatacccgattccgggttgcggcagcggggtccgttcagaagtcagaggaggaatggcgtgccattctctcccctgaccaattccggattttgagacagaaaggcacagagactcaagggagtggagagtataacaagttttttggtgtaggcacctacctctgtgctggttgtggcactccactctacagatccgcaaccaaattcaactcaccctgtggctggccttctttttatgagggtctccctggggccataaatcgcaatccaaacccagatggcataaggatggaaataacttgtgctgcttgtggaggccatcttggtcatgtttttaaaggtgaatggtttcgtaccccaacaaatgaacgccattgtgtcaacagtatatccctcaagttcaaaccaccgcaattttcttaatgccctcttcctgactatatatatacgtcctgattatgtacaactttgatcta

SEQ ID NO: 152 - protein, 171 aa, Solanum lycopersicum
MDSQILKFWPIIPSKNLIFNSKKAVPIRGLSNTRFRVAAAGSVQKSEEEWRAILSPDQFRILRQKGTETQGSGEYNKFFGVGTYLCAGCGTPLYRSATKFNSPCGWPSFYEGLPGAINRNPNPDGIRMEITCAACGGHLGHVFKGEWFRTPTNERHCVNSISLKFKPPQFS

SEQ ID NO: 153 - DNA, 724 bp, Triticum aestivum
ttcggcacgaggcccccttgcgccacagctgcctgaaaaggagaaagggaaatgggcggagtccagcatctgctcaagctgaggatggcgtccccccacgcccacccggccacgcagcccctctccgcgctcccgtccctcctcctcgcccgctcctcctccgccgccgcgtcgtccgcccgccccgccgcctccctctccctccccctctcgtgctcgcgggcgcgggcctactgcccagccggacggcggttgccgggcgccgtggtggcgatgtcgtcgtcggcgcccgcgccggggcccgtgcagaagtcggaggaggagtgggaggccgtcctcacgccggagcagttccgcatcctccgccgcaagggcaccgagtatcctggaacaggtgaatatgacaagttcttcagtgagggtatttacggatgtgctggctgcggaacccccttgtacaaatcatctacgaagttcaactcagggtgtggttggccagcattctatgaaggatttcctggagccataaaacggacggcggatcctgatgggaggcgagttgagatcacatgtgctgcttgtgatgggcatctggggcatgtgttcaaaggggaggggttcaacacgccgactgatgagcgacactgcgtcaacagtatctcactcaagttcgttccggcctctgaagaggctagttgactgagctgatgaacatctatatgag

SEQ ID NO: 154 - protein, 215 aa, Triticum aestivum
MGGVQHLLKLRMASPHAHPATQPLSALPSLLLARSSSAAASSARPAASLSLPLSCSRARAYCPAGRRLPGAVVAMSSSAPAPGPVQKSEEEWEAVLTPEQFRILRRKGTEYPGTGEYDKFFSEGIYGCAGCGTPLYKSSTKFNSGCGWPAFYEGFPGAIKRTADPDGRRVEITCAACDGHLGHVFKGEGFNTPTDERHCVNSISLKFVPASEEAS

SEQ ID NO: 155 - DNA, 609 bp, Triticum aestivum
  misc_feature (3)..(3): n is a, c, g, or t
acncaggacgacccggcagcggcggcggcagctacagggcgggccgccgttcgcgccatgggcgccgcgccgtcttcgccctcgccgtccggacaagccccagggaaagcggataacgcgtctctgagtgatgaggagttgaagaagcgcctcacaaaagaacagtattacgtcactcggcagaagggaactgagagggcattcacaggggaatactggaacactaaaaccccaggcatctaccattgcatctgctgtgacacccctctgtttgagtcatcaaccaagtttgatagtggtactggatggccgtcctattaccagccggttggcgacaatgtgaaaagcaagcttgatatgtcgatcttcttcatgcctcggaccgagtccctgtgtgccgtctgcgacgctcacctggggcatgttttcgacgacgggccaccgccgactgggaagagatattgcatcaacagcgcgtctctgaagtttaagccccagtagtccctggaagaagaatcaagatgcaagcaccagtgcgtcccatgtaaattttggttttggtatgaactatttccagtgtagtagcctagtccgcccggtctgcgcatg

SEQ ID NO: 156 - protein, 147 aa, Triticum aestivum
MGAAPSSPSPSGQAPGKADNASLSDEELKKRLTKEQYYVTRQKGTERAFTGEYWNTKTPGIYHCICCDTPLFESSTKFDSGTGWPSYYQPVGDNVKSKLDMSIFFMPRTESLCAVCDAHLGHVFDDGPPPTGKRYCINSASLKFKPQ

SEQ ID NO: 157 - DNA, 836 bp, Triticum aestivum
ccacgcgtccgagtcgcccccaccgcgcaacaaaaagtctccgctatcctcttcccctcctctgctctctctcgatgcgtgcgcctccctgtctccctcctcggcgctccgccggcttcttgctcccccgcgttcgccgcgcgcgctagcgcgaccgatggcgtccggcgacagcaagccgaggagcgaggaggagtggcgcgccgtcctcaaccccgagcagttccgcatcctccgcctcaagggcaccgagttgccgggaacaggcgagtacaacaagttctacggtgatggggcgtacaagtgcgctggctgcggaacgcccctgtacaaatccaccaccaaatttgactctggctgtggctggccggccttctttgaaggacttcctggagccatacacaggacgcctgaccctgatggtaggagggtagagatcacatgtgcatcttgcggcgggcatttgggccatgtcttcaagggagaaagcttcaagacccctaccgatgagccgcactgcgtcaacagcgtttccatcaaggtttactcctgccctcctcctgattccagttcttggagtcattgggatgaacttcctcaggtccctaaaacccgtgaaaaacaattatggatttaggtccccagagccccgtttttcctcgaaagttatggtggaatggaatttccgcccaaacccaaagtttgccgaaaaagtccggaaaaataaaacactgggataaggaatcttgcgcaagttttcctgccgtgttaaccccaaggctggaaaaccctggaaactcccaaaatcctggttccgggctcgaaaaaagttctct

SEQ ID NO: 158 - protein, 159 aa, Triticum aestivum
MASGDSKPRSEEEWRAVLNPEQFRILRLKGTELPGTGEYNKFYGDGAYKCAGCGTPLYKSTTKFDSGCGWPAFFEGLPGAIHRTPDPDGRRVEITCASCGGHLGHVFKGESFKTPTDEPHCVNSVSIKVYSCPPPDSSSWSHWDELPQVPKTREKQLWI

SEQ ID NO: 159 - DNA, 1195 bp, Triticum aestivum
ggggcgaatccacccctcggggtttagccgaggccgcggggggggaataacaatttaaccagggaaccaggattgcccatatggccctattttgggggcccctaagaaccaagtttgtaccaaaaagcaggctggtacccgtcgggaattccccggatatgttcaacgcaacgcgtcccggacttggagccgaggaccctgacatggactgaaggagtaggaaacaacggcctgaaagggagaaaggggaatgggcggagtccagcatctgctcaagctgaggatggggtcccccccacgcccaacccggccacgcagcccctctccgcgctcccgtccctcctcctcgcccgctcctcctccgccgccgggtcgtccgcccgccccgccgcctccctctccctccccctctcgtgctcgcgggcgcgggcctactgcccagccggacggcggttgccgggcgccgtggtggcgatgtcgtcgtcggcgcccgcgccggggcccgtgcagaagtcggaggaggagtgggaggccgtcctcacgccggagcagttccgcatcctccgccgcaagggcaccgagtatcctggaacaggtgaatatgacaagttcttcagtgagggtatttacggatgtgctggctgcggaacccccttgtacaaatcatctacgaagttcaactcagggtgtggttggccagcattctatgaaggatttcctggagccataaaacggacggcggatcctgatgggaggcgagttgagatcacatgtgctgcttgtgatgggcatctggggcatgtgttcaaaggggaggggttcaacacgccgactgatgagcgacactgcgtcaacagtatctcactcaagttcgttccggcctctgaagaggctagttgactgagctgatgaacatctatatgagaaatggaaacaaaatcttttgtgcaaccatcatagtgactgctggatgtcagaactcagtacttttgacaataatgcaagccccaagtaccgatgctcgctgctaattttggcagtatatactgttacatgtgtaaattctaggttttgttttccctgtggaaattaatagtgagatgtacatttaaaaataaagccgcctgaagaatgcagctcacgttgtttccctttgtgcccaacataatatcttagtgattatccgcaatacacc

SEQ ID NO: 160 - protein, 141 aa, Triticum aestivum
MSSSAPAPGPVQKSEEEWEAVLTPEQFRILRRKGTEYPGTGEYDKFFSEGIYGCAGCGTPLYKSSTKFNSGCGWPAFYEGFPGAIKRTADPDGRRVEITCAACDGHLGHVFKGEGFNTPTDERHCVNSISLKFVPASEEAS

SEQ ID NO: 161 - DNA, 744 bp, Triticum aestivum
cccgcgtccggggaaatgggcggagtccagcatctgctcaagctgaggatggcgtcgccccacgcccacccggccacgcggcccctctcatcgctcccgtccctcctcctcgcccgctcctcctccgccgccaccgccgccgcgtcgtccgcccgccccgcctccctctccctctcgtgctcgcggtcgcgggcgcgggcctactgcccagccggacgacggttgccgggcgccgtggtggctatgtcgtcggcggcgcccacgccggggcccgtgcagaagtcggaggaggagtgggaggccgtcctcacgccggagcagttccgcatcctccgccgcaagggcaccgagtatcctggaacaggtgaatatgacaagttcttcagtgagggtatttacggatgtgctggctgtggaacccccttgtacaaatcatctacgaagttcaactcagggtgtggttggccagcattctatgaaggatttcctggagccataaaacggacggcggatcctgatgggaggcgaattgagatcacatgtgctgcttgtgaaggacatctggggcatgtgttcaaaggggaggggttcaacacgccgactgatgagcgacactgcgtcaacagtatctcactcaagttcgttccggcctctgaagaggctagttgactgagctgatgaacatctatatgagaaatggaacaaaacctttgtgcaacatcatagtgactactggatgtcaga

SEQ ID NO: 162 - protein, 217 aa, Triticum aestivum
MGGVQHLLKLRMASPHAHPATRPLSSLPSLLLARSSSAATAAASSARPASLSLSCSRSRARAYCPAGRRLPGAVVAMSSAAPTPGPVQKSEEEWEAVLTPEQFRILRRKGTEYPGTGEYDKFFSEGIYGCAGCGTPLYKSSTKFNSGCGWPAFYEGFPGAIKRTADPDGRRIEITCAACEGHLGHVFKGEGFNTPTDERHCVNSISLKFVPASEEAS

SEQ ID NO: 163 - DNA, 919 bp, Triticum aestivum
ccacgcgtccggggaactgagagggcattcacaggggaatactggaacactaaaaccccaggctgctaccttggtctcgtcccgagcgcacctgtcctcctacctcccgcccctcctcccctccgcgcgaccccggcccaggacgacccgcagcggcggcggcagcttcaggcgggccgccgttcgcgccatgggcgccgcgccgtcttcgccctcgccgtccggacaagccccagggaaagcggataacgcgtctctgagtgatgaggagttgaagaagcgcctcacaaaagaacagtattacgtcactcggcagaagggaactgagagggcattcacaggggaatactggaacactaaaaccccaggcatctaccattgcatctgctgtgacacccctctgtttgagtcatcaaccaagtttgatagtggtactggatggccgtcctattaccagccggttggcgacaatgtgaaaagcaagcttgatatgtcaatcttcttcatgcctcggaccgagtccctgtgtgccgtctgcgacgctcacctggggcatgttttcgacgacgggccaccgccgactgggaagagatattgcatcaacagcgcgtctctgaagtttaagccccagtagtccctggaagaagaatcaagatgcaagcaccatcgcgtcccatgtaaattttggtttgggtatgaactatttccagtgtagtagcctaatccgcccggtctgcgcatgtaaattgataatttccaggtttgtaatttgtaaagccatttgtccgaaacatctgcatgttcctccatgggcagtatcgttggcccttctgagtgtcaggagttcctgtgactggggctttaaacatcatgatatcagagaagaaattgggctgcatctgaggtactccctccgttc

SEQ ID NO: 164 - protein, 147 aa, Triticum aestivum; identical to SEQ ID NO: 156

SEQ ID NO: 165 - DNA, 951 bp, Zea mays
cggtgtcacaaaacctgaccgatggcggcccggtgctccacagctgcctccgtgtccgtggtcagaacaggatcgcgagacctctccccctccttttccttcacagccgcggcgctcccctcggcgcgtctgaggccggtaggagcgtgggtccgcggtggagggtacacctgcaggctccgcgccgtctgcgccatgggctccgcgccgtcgtcgtcccaatccccgtcgccgcacacgccttcaggacaaacccaagggaaagcagattataaatcactgagtgaagaggagtggaagaagcgcctgactgaagagcagtattatgttactcggcagaagggcactgaaagagcattcactggggaatactggaatactaaaaccccaggcatttatcagtgtgtctgctgcgacacccctctgtttcagtcatcaaccaaatttgatagtggtactgggtggccatcctattataaaccaattggtgaaaatgtcaagagcaagcttgatatgtcaatcatttttatgccccggaccgaggtgctctgtgcaacctgtgatgctcatctggggcatgtcttcgatgacgggccaccaccaacagggaagagatactgtatcaatagtgcatctctgaaattgaagccccaatagttgctggatactttagcaagaagtcaactataacgctggtccgccctatgtaaacttcggggttatgtatataaactactcgagttgtagcatatttattattctctttgttatgtaatatatgtgttcacaaaccgatgaaagtatgaaacaaacagccgctacttcactctggtattctggtctagaattaaggtgttgtttggttgacgaattgtaacgtaaatggcaacggtaatggtttgcactcgagtgacagttgacaacggtaataaatttaaatagatctttatt

SEQ ID NO: 166 - protein, 211 aa, Zea mays
MAARCSTAASVSVVRTGSRDLSPSFSFTAAALPSARLRPVGAWVRGGGYTCRLRAVCAMGSAPSSSQSPSPHTPSGQTQGKADYKSLSEEEWKKRLTEEQYYVTRQKGTERAFTGEYWNTKTPGIYQCVCCDTPLFQSSTKFDSGTGWPSYYKPIGENVKSKLDMSIIFMPRTEVLCATCDAHLGHVFDDGPPPTGKRYCINSASLKLKPQ

SEQ ID NO: 167 - DNA, 1619 bp, Zea mays
aataaaaatctatttaaatttattaccattgtcaactgtcactcaagtgcaaaccattaccgttgtcatttacgttacaattcgtcaaccaaacaataccttagttctagaccagaataccagagtgaagtagcggctgcttgtttcatcggtttgtggacacatatatattacataacaaagagaataataaatatgctacaactcgagtagtttatatacagaaacccgaagtttacatagggcggaccagcgttatagttgacttcttgctaaagtatccagcaactattggggcttcaatttcagagatgcactgttgatacagtacctcttccctgttggtggtggcccgtcatcgaagacatgccccagatgagcatcacaggttgcacagagcacctcggtccggggcataaaaatgattgacatatcaagcttgctcttgacattttcaccaattggtttataataggatggccacccagtaccactatcaaatttggttgatgactgaaacagaggggtgtcgcagcagacacactgataaatgcctggcgttttagtattccagtattccccagtgaatgctctttcagtgcccttctgccgagtaacataatactgctcttcagtcaggcgccttcgctgtcgacgatttcgtacgaaatcgtcgacagcgaagttgttgagcgcggagagaggagaggcgcagagcatcgacgatggcgagcggcagcatgaagagggagatcagcgagacccacgacaccctccgcttcggcctcaatgccggcgtcaaggccgacctcgcgccgccgcacccgctccagtccagcatccaatcggaggccaagttctgggcggacaagaagaagtttgggacagaggccatctacggatccgccttgaacatccgcaaggatctcgatgcccaaatcctctcaaggttccaaaggccccctggtgctttgccatcatctctgcttggatatgaggcactgacaggttccctagatgattttggttttgaagattatcttaacatgcctcaagattctgaaggtttccgtcaacctgacatgcaccacggaatggaggttcgccttggtttgtccaagggacctatctgccctagcttcagttgaggcagtgaatgtagttctgcggttctgccgcacgttgatgcaccttagtccagtacactcgggtcaataaaagaccacattaggatggtgaaacggtgaaaactgatggcttgcatatgttcagagtgttatgttgtaatgaacagtgttatgttgtaatgaacgcatatatcgcatgattgatagcttggctagctgtgcgcaggcttagtggaagcattgactggggtgcaggtcggcgcgagcccggctcttatgggtgtaggaaccaatcacgccgattgtgaagcatcgcagttgagcttcaggatctctgcagctgcaggtggcttcttccgtactcgaattagaggtggctgtgaattgcaatccttttgttatttttttctaacttgtacggaggaaagcaatccataggaatttttaaagaaaattgatgagattaaatccaataaaaaaaaaaaaaaaaaa

SEQ ID NO: 168 - protein, 143 aa, Zea mays
MLCASPLSALNNFAVDDFVRNRRQRRRLTEEQYYVTRQKGTERAFTGEYWNTKTPGIYQCVCCDTPLFQSSTKFDSGTGWPSYYKPIGENVKSKLDMSIIFMPRTEVLCATCDAHLGHVFDDGPPPTGKRYCINSASLKLKPQ

SEQ ID NO: 169 - DNA, 1592 bp, Zea mays
tttttttttttaataaagatctatttaaatttattaccgttgtcaactgtcactcgagtgcaaaccattaccgttgccatttacgttacaattcgtcaaccaaacaacaccttaattctagaccagaataccagagtgaagtagcggctgtttgtttcatactttcatcggtttgtgaacacatatattacataacaaagagaataataaatatgctacaactcgagtagtttatatacataaccccgaagtttacatagggcggaccagcgttatagttgacttcttgctaaagtatccagcaactattggggcttcaatttcagagatgcactgcacggaaaaaggatagcagtgagcacaagaagtgacaatttagttaacctatttgccccacgttctcaacatttttccagattcatcgcagctatggcagcacgataatggaaatagatgctctccactacctccctctcccacctgccagtgactcagttgctgtttgattcataaaatgtgacgtaatgctcaagtagcaatggtaataagtttaaataggctgatatcactttctagtgtagtattcgattacggttggacttaaacaaacatgtagtattcgattacggttggacttaaacaaatatgatttaatgttatcaattaccatcacgttagaaatatgtgaaccaaacagcacctcagatcataagaaagtacaggcaagtgggcttgattgtcagtggctcactgcagaggaaagtgcagcaggactcgcaatgacacaatccctagacctattaccaccaccgaaacgtgtgcagaccaaaccttggagttagagaggacatggagcggggtaatgtggctataaacggaagcgaaattatacctattgatacagtatctcttccctgttggtggtggcccgtcatcgaagacatgccccagatgagcatcacaggttgcacagagcacctcggtccggggcataaaaatgattgacatatcaagcttgctcttgacattttcaccaattggtttataataggatggccacccagtaccactatcaaatttggttgatgactgaaacagaggggtgtcgcagcagacacactgataaatgcctggggttttagtattccagtattccccagtgaatgctctttcagtgcccttctgccgagtaacataatactgctcttcagtcaggcgcttcttccactcctcttcactcagtgatttataatctgctttcccttgggtttgtcctgaaggcgtgtgcggcgacggggattgggacgacgacggcgcggagcccatggcgcagacggcgcggagcctgcaggtgtaccctccaccgcggacccacgctcctaccggcctcagacgcgccgaggggagcgccgcggctgtgaaggaaaaggagggggagaggtctcgcgatcctgttctgaccacggaggcagctgtggagcaccgggccgccatcggtcaggttttgtgacaccgagctctgatgcttgttggatggcgcaccaccgatgctggtaataactacacaacagtgcgtgcagccaggcgcagcc

SEQ ID NO: 170 - protein, 248 aa, Zea mays
MAARCSTAASVVRTGSRDLSPSFSFTAAALPSARLRPVGAWVRGGGYTCRLRAVCAMGSAPSSSQSPSPHTPSGQTQGKADYKSLSEEEWKKRLTEEQYYVTRQKGTERAFTGEYWNTKTPGIYQCVCCDTPLFQSSTKFDSGTGWPSYYKPIGENVKSKLDMSIIFMPRTEVLCATCDAHLGHVFDDGPPPTGKRYCINRYNFASVYSHITPLHVLSNSKVWSAHVSVVVIGLGIVSLRVLLHFPLQ

SEQ ID NO: 171 - DNA, 1219 bp, Zea mays
tttttttttttttttaatcacgccagagtaacagctgatgtaaatgacgaatcacgtagagtaacagctgcttatgattagtttcatctcacagccagagtagcagaatgcacgcacgcacacatgctcaataaatcttattcgtcgctttggtgtacttcccacagttccaggacacgagaatctcaagatgatctaggaggagccaggactgaacttgatcgagacgctattcacgcagtggcgctcatcagtaggtgtcttgaagccttcacccttgaacacatggcccagatggccaccgcaggctgcacatgtgatctctaccctcctaccatcaggatctggtgttcggtttatggctcctggaagcccctcaaagaatgcaggccagccgcagccagaatcaaattttgtggcggacttgtacaggggagtcccgcagccagcgcagttataaaccccgtcgccgtagaatttgttgtactctcctgtcccgggtaacctggacatcaatgtgagcctagcttgagaacagatgtttaattactatggggccatttacatgccgagtgacaggtacgatggtattttcctggagcaaggtccaaagcctccaaggtaacagaaagcacggtactggaattgccagtatatgatttctttccttccaacaccttattaagggtttgttcggttctaccccaatccgtatggattaagggggttttaatccctagtaagtcaaaatctctctcaatccgtatcaattccctccaattcatatggattggaaataaccgaacaagccctaactaggaatccatgactgaacatagcctgaagagcttgataaagcattcacagttacacacacatgtaactgctccactcttctaatagaggttaaggttacagctcacaaatcagcatcaccattcgaaatttgtaaatttgcatgtataggcggtaattactaacgactgttcaaaattgtgctataattttacccacaagatattccaatgatagtcaactgacacttggatcaacagtgttttacttccaatcagtatttcaaatcacaggctatgacatctggctacctgcctcctcaaacagctaatcgccagataaatctggctttagcagctaaagtgtacatggggagcaaatagctaaatcctcctcaaacaacgagatccggagatgaaacccg

SEQ ID NO: 172 - protein, 105 aa, Zea mays
MSRLPGTGEYNKFYGDGVYNCAGCGTPLYKSATKFDSGCGWPAFFEGLPGAINRTPDPDGRRVEITCAACGGHLGHVFKGEGFKTPTDERHCVNSVSIKFSPGSS

SEQ ID NO: 173 - protein, 4 aa, Artificial sequence
  Motif 1
QYRS

SEQ ID NO: 174 - protein, 6 aa, Artificial sequence
  Motif 2
  VARIANT (1)..(1): / replace = "His" / replace = "Glu" / replace = "Asp" / replace = "Gly"
  VARIANT (2)..(2): / replace = "Ser"
  VARIANT (3)..(3): / replace = "Arg"
  VARIANT (4)..(4): / replace = "Lys" / replace = "Arg"
  VARIANT (5)..(5): / replace = "Phe"
  VARIANT (6)..(6): / replace = "Cys" / replace = "Glu"
YHQQYL

SEQ ID NO: 175 - protein, 8 aa, Artificial sequence
  Motif 3
  VARIANT (1)..(1): / replace = "Val"
  VARIANT (2)..(2): / replace = "Met" / replace = "Ile" / replace = "Ala" / replace = "Arg" / replace = "Phe" / replace = "Thr"
  VARIANT (3)..(3): / replace = "Val" / replace = "Arg"
  VARIANT (4)..(4): / replace = "Asp" / replace = "Thr"
  VARIANT (5)..(5): / replace = "Val" / replace = "Gln"
  VARIANT (6)..(6): / replace = "Lys" / replace = "Ala" / replace = "Val" / replace = "Ile"
  VARIANT (7)..(7): / replace = "Gly" / replace = "Thr" / replace = "Lys"
  VARIANT (8)..(8): / replace = "Ser" / replace = "Pro" / replace = "Thr" / replace = "Gln"
IVTEILPA

SEQ ID NO: 176 - protein, 97 aa, Artificial sequence
  Motif 4
  UNSURE (1)..(1): Xaa can be any one of Ala, Phe, Thr or no amino acid
  UNSURE (2)..(2): Xaa can be any one of Gln, Val, Glu, Ser, Cys, Thr or no amino acid
  UNSURE (3)..(3): Xaa can be any one of Phe, Ile, Ala or no amino acid
  UNSURE (4)..(4): Xaa can be any one of Gly, Ala or no amino acid
  UNSURE (5)..(5): Xaa can be any one of Ala, Leu, Ser, Thr or no amino acid
  UNSURE (6)..(6): Xaa can be Gly or no amino acid
  UNSURE (7)..(7): Xaa can be any one of Cys, Ser or no amino acid
  UNSURE (8)..(8): Xaa can be Phe or no amino acid
  UNSURE (9)..(9): Xaa can be Trp or no amino acid
  UNSURE (10)..(10): Xaa can be any one of Gly, Arg, Ser or no amino acid
  UNSURE (11)..(11): Xaa can be any one of Val, Ser, Gly or no amino acid
  UNSURE (12)..(12): Xaa can be Glu or no amino acid
  UNSURE (13)..(13): Xaa can be Leu or no amino acid
  UNSURE (14)..(14): Xaa can be any one of Ala, Met, Gly, Val, Thr or no amino acid
  UNSURE (15)..(15): Xaa can be any one of Phe, Cys, Ala, Tyr or no amino acid
  UNSURE (16)..(16): Xaa can be any one of Gln, Trp, Arg, Gly or no amino acid
  UNSURE (17)..(17): Xaa can be any one of Arg, Cys, Glu or no amino acid
  UNSURE (18)..(18): Xaa can be any one of Val, Ile, Leu, Ser, Ala or no amino acid
  UNSURE (19)..(19): Xaa can be any one of Pro, His, Arg, Asn, Ser or no amino acid
  UNSURE (20)..(20): Xaa can be Gly or no amino acid
  UNSURE (21)..(21): Xaa can be any one of Val, Leu or no amino acid
  UNSURE (22)..(22): Xaa can be any one of Thr, Val, Ile, Tyr, Arg, Ala or no amino acid
  UNSURE (23)..(23): Xaa can be any one of Lys, Arg, Glu, Ser, Ala, Tyr, Gln, Val or no amino acid
  UNSURE (24)..(24): Xaa can be any one of Thr, Ala or no amino acid
  UNSURE (25)..(25): Xaa can be any one of Glu, Ser, Arg, Ala or no amino acid
  UNSURE (26)..(26): Xaa can be any one of Val, Ala or no amino acid
  UNSURE (26)..(26): Xaa can be any one of Val, Ala or no amino acid
  UNSURE (27)..(27): Xaa can be Gly or no amino acid
  UNSURE (28)..(28): Xaa can be Tyr or no amino acid
  UNSURE (29)..(29): Xaa can be any one of Thr, Ser, Ala, Val, Ile or no amino acid
  UNSURE (30)..(30): Xaa can be any one of Gln, Gly, Ala, His or no amino acid
  UNSURE (31)..(31): Xaa can be Gly or no amino acid
  UNSURE (32)..(32): Xaa can be any one of Asn, Ser, Leu, His, Lys, Ala, Asp, Gln or no amino acid
  UNSURE (33)..(33): Xaa can be any one of Leu, Lys, Ser, Thr, Ile, Val, Phe, Arg, Met or no amino acid
  UNSURE (34)..(34): Xaa can be any one of His, Thr, Ala, Ser, Gln, Lys, Glu, Pro, Asp or no amino acid
  UNSURE (35)..(35): Xaa can be any one of Asn, Asp, His, Arg, Gly, Glu, Met or no amino acid
  UNSURE (36)..(36): Xaa can be Pro or no amino acid
  UNSURE (37)..(37): Xaa can be any one of Thr, Ser, Leu, Asn, Asp or no amino acid
  UNSURE (38)..(38): Xaa can be Tyr or no amino acid
  UNSURE (39)..(39): Xaa can be any one of Glu, Arg, Lys, Tyr, Gly, Gln or no amino acid
  UNSURE (40)..(40): Xaa can be any one of Asp, Ala, Leu or no amino acid
  UNSURE (41)..(41): Xaa can be any one of Val, Glu, Asp, Ala, Ile or no amino acid
  UNSURE (42)..(42): Xaa can be any one of Cys, Tyr or no amino acid
  UNSURE (43)..(43): Xaa can be any one of Thr, Ser, Arg, His, Gly or no amino acid
  UNSURE (44)..(44): Xaa can be any one of Gly, Asn, Ser or no amino acid
  UNSURE (45)..(45): Xaa can be any one of Ala, Leu, Val, Gln, Arg, Lys, Thr, Asp, Met or no amino acid
  UNSURE (46)..(46): Xaa can be any one of Thr, Gly, Ala or no amino acid
  UNSURE (47)..(47): Xaa can be any one of Tyr, Asp, Gly, Asn, Ser, Lys or no amino acid
  UNSURE (48)..(48): Xaa can be His or no amino acid
  VARIANT (49)..(49): / replace = "Ala" / replace = "Thr" / replace = "Val" / replace = "Asn" / replace = "Met"
  VARIANT (50)..(50): / replace = "Gln"
  VARIANT (51)..(51): / replace = "Ser" / replace = "Phe" / replace = "Ala" / replace = "Gly" / replace = "Cys"
  VARIANT (52)..(52): / replace = "Leu" / replace = "Asp"
  VARIANT (53)..(53): / replace = "Gln" / replace = "Glu" / replace = "Lys" / replace = "Tyr"
  VARIANT (54)..(54): / replace = "Ile" / replace = "Leu / replace = "Met"
  VARIANT (55)..(55): / replace = "His" / replace = "Glu" / replace = "Thr" / replace = "Val" / replace = "Ile"
  VARIANT (56)..(56): / replace = "Phe"
  VARIANT (57)..(57): / replace = "Asn"
  VARIANT (58)..(58): / replace = "Val" / replace = "Leu"
  VARIANT (59)..(59): / replace = "Arg" / replace = "Ser" / replace = "Gln" / replace = "Ala" / replace = "Asn"
  VARIANT (60)..(60): / replace = "Val" / replace = "Leu" / replace = "Ile" / replace = "Met" / replace = "Gln" / replace = "Glu" / replace = "Asp" / replace = "Asn"
  VARIANT (61)..(61): / replace = "Ile" / replace = "Val" / replace = "Gly"
  VARIANT (62)..(62): / replace = "Pro" / replace = "Thr" / replace = "Gly" / replace = "Gln" / replace = "His"
  VARIANT (63)..(63): / replace = "Phe"
  VARIANT (64)..(64): / replace = "Arg" / replace = "Ser" / replace = "Lys" / replace = "Thr" / replace = "Glu" / replace = "Gln"
  VARIANT (65)..(65): / replace = "Gln" / replace = "Lys" / replace = "Asn" / replace = "Thr" / replace = "Ser"
  VARIANT (66)..(66): / replace = "Ile"
  VARIANT (67)..(67): / replace = "Val"
  VARIANT (68)..(68): / replace = "Glu" / replace = "Ser" / replace = "Ala" / replace = "Lys"
  VARIANT (69)..(69): / replace = "Phe" / replace = "Ile" / replace = "Leu" / replace = "Met" / replace = "Ala" / replace = "Thr"
  VARIANT (70)..(70): / replace = "His" / replace = "Leu"
  VARIANT (71)..(71): / replace = "Tyr"
  VARIANT (72)..(72): / replace = "Ser" / replace = "Gln" / replace = "Lys" / replace = "Thr" / replace = "Asp" / replace = "Asn"
  VARIANT (73)..(73): / replace = "Lys" / replace = "Ser" / replace = "Met" / replace = "Asn"
  VARIANT (75)..(75): / replace = "Asn"
  VARIANT (76)..(76): / replace = "Ser"
  VARIANT (77)..(77): / replace = "Arg"
  VARIANT (78)..(78): / replace = "Gln" / replace = "Glu" / replace = "Ala"
  VARIANT (79)..(79): / replace = "Pro" / replace = "Val" / replace = "Ile" / replace = "Gly" / replace = "Lys" / replace = "Phe"
  VARIANT (80)..(80): / replace = "Phe" / replace = "His" / replace = "Met" / replace = "Asp"
  VARIANT (81)..(81): / replace = "Gly"
  VARIANT (83)..(83): / replace = "Val"
  VARIANT (84)..(84): / replace = "Pro" / replace = "Gly" / replace = "Ala" / replace = "Glu"
  VARIANT (85)..(85): / replace = "Leu"
  VARIANT (86)..(86): / replace = "Gln" / replace = "Arg" / replace = "Leu" / replace = "Ser"
  VARIANT (88)..(88): / replace = "Asn" / replace = "Ala" / replace = "Ser" / replace = "Pro"
  VARIANT (93)..(93): / replace = "Val" / replace = "Ala" / replace = "Cys" / replace = "Ile"
  VARIANT (94)..(94): / replace = "Val" / replace = "Leu"
  VARIANT (95)..(95): / replace = "Phe"
  VARIANT (96)..(96): / replace = "Thr" / replace = "Phe" / replace = "Cys"
  VARIANT (97)..(97): / replace = "Asn" / replace = "His" / replace = "Gln" / replace = "Thr" / replace = "Ser"
XXXXXXXXXXXXXXXXXXXXXXXXXXXXXXXXXXXXXXXXXXXXXXXXSEVVRVQYDPKACKYDDLLDVFWARHDPTTLNRQGNDVGTQYRSGIYYY

SEQ ID NO: 177 - protein, 3 aa, Artificial sequence
  Motif 5
GWP

SEQ ID NO: 178 - protein, 11 aa, Artificial sequence
  Motif 6
  VARIANT (1)..(1): / replace = "Val"
  VARIANT (2)..(2): / replace = "Phe" / replace = "Leu"
  VARIANT (3)..(3): / replace = "Asp" / replace = "Glu" / replace = "Gln" / replace = "Ser" / replace = "Arg"
  UNSURE (4)..(4): Xaa can be any one of Ser, Thr or no amino acid
  UNSURE (5)..(5): Xaa can be any one of Thr, Ser, Ala, Ile, Leu, Lys, Asp or no amino acid
  UNSURE (6)..(6): Xaa can be any one of Thr, Ala or no amino acid
  UNSURE (7)..(7): Xaa can be Lys or no amino acid
  UNSURE (8)..(8): Xaa can be Phe or no amino acid
  UNSURE (9)..(9): Xaa can be any one of Asp, Asn or no amino acid
  VARIANT (10)..(10): / replace = "Ala" / replace = "Arg"
  VARIANT (11)..(11): / replace = "Pro"
LYKXXXXXXSG

SEQ ID NO: 179 - protein, 9 aa, Artificial sequence
  Motif 7
  UNSURE (1)..(1): Xaa can be any one of Gly, Asp, Glu, Asn or no amino acid
  UNSURE (2)..(2): Xaa can be any one of Gly, Ala, Ser, Ile or no amino acid
  UNSURE (3)..(3): Xaa can be any one of His, Phe or no amino acid
  UNSURE (4)..(4): Xaa can be any one of Leu, Phe or no amino acid
  UNSURE (5)..(5): Xaa can be any one of Gly, Phe, Cys or no amino acid
  VARIANT (6)..(6): / replace = "Phe"
  VARIANT (7)..(7): / replace = "Ile, / replace = "Ser"
  VARIANT (8)..(8): / replace = "Thr" / replace = "His" / replace = "Leu" / replace = "Val"
  VARIANT (9)..(9): / replace = "Asp" / replace = "Pro" / replace = "Met" / replace = "Leu" / replace = "Ile" / replace = "Arg"
XXXXXHVFK

SEQ ID NO: 180 - protein, 40 aa, Artificial sequence
  Motif 8
  UNSURE (1)..(1): Xaa can be any one of Lys, Arg, Leu, Thr, Trp, Leu, Phe, Ile or no amino acid
  UNSURE (2)..(2): Xaa can be any one of Ser, Thr, Arg, Gln, Pro, Lys, Gly or no amino acid
  UNSURE (3)..(3): Xaa can be any one of Glu, Asp, As,; Ala, Thr, Lys or no amino acid
  UNSURE (3)..(3): Xaa can be any one of Glu, Asp, Asn, Ala, Thr, Lys or no amino acid
  UNSURE (4)..(4): Xaa can be any one of Glu, Ala, Gln, Gly, Arg or no amino acid
  UNSURE (5)..(5): Xaa can be any one of Glu, Asp, Arg or no amino acid
  UNSURE (6)..(6): Xaa can be any one of Trp, Leu, Gln or no amino acid
  UNSURE (7)..(7): Xaa can be any one of Arg, Lys, Ala, Val, Glu, Gln or no amino acid
  UNSURE (8)..(8): Xaa can be any one of Ala, Val, Lys, Thr, Gln, Arg or no amino acid
  UNSURE (9)..(9): Xaa can be any one of Val, Ile, Gln, Arg, Lys, Gly or no amino acid
  UNSURE (10)..(10): Xaa can be any one of Leu, Ala or no amino acid
  UNSURE (11)..(11): Xaa can be any one of Ser, Thr, Glu, Asn or no amino acid
  UNSURE (12)..(12): Xaa can be any one of Pro, Asp, Ser, Gln, Ala, Asn, Glu, Lys or no amino acid
  UNSURE (13)..(13): Xaa can be any one of Glu, Asp, Gln, Ala or no amino acid
  VARIANT (14)..(14): / replace = "Glu" / replace = "Ala"
  UNSURE (15)..(15): Xaa can be any one of Phe, Tyr, Arg or no amino acid
  UNSURE (16)..(16): Xaa can be any one of Arg, Tyr, His, Lys, Thr, Gln or no amino acid
  UNSURE (17)..(17): Xaa can be any one of Ile, Val or no amino acid
  UNSURE (18)..(18): Xaa can be any one of Leu, Thr, Ala or no amino acid
  UNSURE (19)..(19): Xaa can be any one of Arg, Leu or no amino acid
  UNSURE (20)..(20): Xaa can be any one of Gln, Lys, Leu, Asp, Arg, Glu, His or no amino acid
  UNSURE (21)..(21): Xaa can be any one of Lys, Ala, Glu, His or no amino acid
  VARIANT (22)..(22): / replace = "Met" / replace = "Ser" / replace = "Ala"
  VARIANT (23)..(23): / replace = "Ile" / replace = "Ser"
  VARIANT (24)..(24): / replace = "Asp" / replace = "Arg"
  VARIANT (25)..(25): / replace = "Ala" / replace = "Lys" / replace = "Asn" / replace = "Tyr" / replace = "Thr" / replace = "Ile" / replace = "Pro" / replace = "Phe" / replace = "Leu"
  VARIANT (26)..(26): / replace = "Ala" / replace = "Lys" / replace = "Gln" / replace = "Arg"
  VARIANT (27)..(27): / replace = "Phe" / replace = "Asn"
  VARIANT (28)..(28): / replace = "Ser" / replace = "Lys" / replace = "Cys"
  VARIANT (29)..(29): / replace = "Ser" / replace = "Glu"
  VARIANT (30)..(30): / replace = "Pro" / replace = "Val" / replace = "Arg"
  VARIANT (31)..(31): / replace = "Phe" / replace = "Leu"
  VARIANT (32)..(32): / replace = "Asp" / replace = "Trp" / replace = "Val" / replace = "Thr" / replace = "Leu" / replace = "Glu"
  VARIANT (33)..(33): / replace = "Asn" / replace = "Gln" / replace = "Asp"
  VARIANT (34)..(34): / replace = "Thr" / replace = "Val" / replace = "Leu" / replace = "Lys" / replace = "Glu" / replace = "Ser"
  VARIANT (35)..(35): / replace = "Trp" / replace = "Tyr" / replace = "Lys" / replace = "His" / replace = "Asp" / replace = "Ser"
  VARIANT (36)..(36): / replace = "Asn" / replace = "Ala" / replace = "Gly" / replace = "Glu" / replace = "Adp" / replace = "Lys" / replace = "Arg"
  VARIANT (37)..(37): / replace = "Pro" / replace = "Ala" / replace = "Asp" / replace = "Lys" / replace = "Gln" / replace = "Val"
  VARIANT (39)..(39): / replace = "Val" / replace = "Ala" / replace = "Thr"
  VARIANT (40)..(40): / replace = "Phe"
XXXXXXXXXXXXXQXXXXXXXGTERPGTGEYNKFFTEGIY

SEQ ID NO: 181 - protein, 12 aa, Artificial sequence
  Motif 9
  VARIANT (2)..(2): / replace = "Val" / replace = "Ile" / replace = "Arg"
  VARIANT (3)..(3): / replace = "Cys" / replace = "Leu"
  VARIANT (5)..(5): / replace = "Ala" / replace = "Asp" / replace = "Asn" / replace = "Lys" / replace = "Gln" / replace = "Glu"
  VARIANT (6)..(6): / replace = "Ser" / replace = "Ala" / replace = "Leu" / replace = "Asn"
  VARIANT (7)..(7): / replace = "Ala" / replace = "Asp" / replace = "Lys"
  VARIANT (8)..(8): / replace = "Val"
  VARIANT (9)..(9): / replace = "Phe" / replace = "Leu"
  VARIANT (10)..(10): / replace = "Glu" / replace = "Asp" / replace = "Gln" / replace = "Ser" / replace = "Arg"
  UNSURE (11)..(11): Xaa can be Ser or no amino acid
  VARIANT (12)..(12): / replace = "Ser" / replace = "Lys" / replace = "Asp" / replace = "Ala" / replace = "Ile" / replace = "Leu"
CAGCGTPLYKXT

SEQ ID NO: 182 - protein, 28 aa, Artificial sequence
  Motif 10
  VARIANT (1)..(1): / replace = "Ser"
  VARIANT (2)..(2): / replace = "Tyr"
  VARIANT (3)..(3): / replace = "Tyr" / replace = "Trp" / replace = "Asp"
  VARIANT (4)..(4): / replace = "Gln" / replace = "Asp" / replace = "Arg" / replace = "Ala"
  VARIANT (5)..(5): / replace = "Pro" / replace = "Thr" / replace = "Ala"
  VARIANT (6)..(6): / replace = "Val" / replace = "Leu" / replace = "Phe"
  VARIANT (7)..(7): / replace = "Pro" / replace = "Ala" / replace = "Asp"
  VARIANT (8)..(8): / replace = "Ala" / replace = "Pro" / replace = "Asn" / replace = "Asp" / replace = "Lys" / replace = "Glu"
  VARIANT (9)..(9): / replace = "Asn" / replace = "Thr"
  VARIANT (10)..(10): / replace = "Val" / replace = "His"
  VARIANT (11)..(11): / replace = "Lys" / replace = "Thr" / replace = "Gly" / replace = "Val" / replace = "Ile" / replace = "Ala"
  VARIANT (12)..(12): / replace = "Gln" / replace = "Ser" / replace = "Glu" / replace = "Thr"
  VARIANT (13)..(13): / replace = "Lys" / replace = "His" / replace = "Ile" / replace = "Ala" / replace = "Glu" / replace = "Ser" / replace = "Asn"
  VARIANT (14)..(14): / replace = "Leu" / replace = "Arg" / replace = "Thr" / replace = "Ala" / replace = "Met" / replace = "Val" / replace = "Ile" / replace = "Glu"
  VARIANT (15)..(15): / replace = "Glu" / replace = "Arg" / replace = "Ile" / replace = "Gly" / replace = "Asn"
  VARIANT (16)..(16): / replace = "Leu" / replace = "Ala" / replace = "Asp" / replace = "Arg" / replace = "Trp" / replace = "Met"
  UNSURE (17)..(17): Xaa can be any one of Asp, Glu, Ser, Thr, Ala, Gly or no amino acid
  UNSURE (18)..(18): Xaa can be any one of Gly, Ile, Ser, Phe, His or no amino acid
  UNSURE (19)..(19): Xaa can be any one of Arg, Ile, Phe, Pro, Gly, His, Leu, Lys, Met or no amino acid
  UNSURE (20)..(20): Xaa can be any one of Arg, Phe, Ser, Gly, Met or no amino acid
  UNSURE (21)..(21): Xaa can be any one of Met, Val, Tyr, Ile, Thr or no amino acid
  UNSURE (22)..(22): Xaa can be any one of Pro, Arg, Val or a gap
  UNSURE (23)..(23): Xaa can be Arg or no amino acid
  UNSURE (24)..(24): Xaa can be any one of Gln, Thr or no amino acid
  UNSURE (25)..(25): Xaa can be any one of Glu, Ala or no amino acid
  UNSURE (26)..(26): Xaa can be any one of Ile, Val, Ser, Thr or no amino acid
  UNSURE (27)..(27): Xaa can be any one of Thr, Leu, Ile, Val, His, Asn or no amino acid
  UNSURE (28)..(28): Xaa can be Cys or no amino acid
AFFEGIGGAINRTPXXXXXXXXXXXXXX

SEQ ID NO: 183 - protein, 25 aa, Artificial sequence
  Motif 11
  UNSURE (1)..(1): Xaa can be any one of Gly, Ala, Ser, Ile or no amino acid
  UNSURE (2)..(2): Xaa can be any one of His, Phe or no amino acid
  UNSURE (3)..(3): Xaa can be any one of Leu, Phe or no amino acid
  UNSURE (4)..(4): Xaa can be any one of Gly, Phe, Cys or no amino acid
  VARIANT (5)..(5): / replace = "Phe"
  VARIANT (6)..(6): / replace = "Ile" / replace = "Ser"
  VARIANT (7)..(7): / replace = "Thr" / replace = "His" / replace = "Leu" / replace = "Val"
  VARIANT (8)..(8): / replace = "Asp" / replace = "Pro" / replace = "Met" / replace = "Leu" / replace = "Ile" / replace = "Arg"
  VARIANT (9)..(9): / replace = "Asp" / replace = "Asn" / replace = "Thr" / replace = "Val"
  VARIANT (10)..(10): / replace = "Gly" / replace = "Arg" / replace = "His"
  VARIANT (11)..(11): / replace = "Pro" / replace = "Asn" / replace = "Asp" / replace = "Trp" / replace = "Ser"
  VARIANT (12)..(12): / replace = "Pro" / replace = "His" / replace = "Tyr" / replace = "Ile" / replace = "Asn" / replace = "Arg" / replace = "Ser"
  UNSURE (13)..(13): Xaa can be any one of Ser, Leu, Pro, Ala, Asp, Gly, Lys, Arg or no amino acid
  UNSURE (14)..(14): Xaa can be any one of Thr, Arg, Asn, Val or no amino acid
  UNSURE (15)..(15): Xaa can be any one of Pro, Asp, Ala, Phe, Thr or no amino acid
  VARIANT (16)..(16): / replace = "Leu" / replace = "Phe" / replace = "Ser" / replace = "Arg"
  VARIANT (17)..(17): / replace = "Gly" / replace = "Leu" / replace = "Tyr" / replace = "Asn"
  VARIANT (18)..(18): / replace = "Lys" / replace = "Ala" / replace = "Asn" / replace = "Gln" / replace = "Leu"
  VARIANT (19)..(19): / replace = "Lys" / replace = "Asp" / replace = "Glu" / replace = "Ala" / replace = "Pro"
  VARIANT (20)..(20): / replace = "Tyr" / replace = "Ile" / replace = "Leu" / replace = "Lys" / replace = "Cys" / replace = "Phe"
  UNSURE (21)..(21): Xaa can be any one of Cys, Val or no amino acid
  UNSURE (22)..(22): Xaa can be any one of Val, Leu, Ile, Ser, Met or no amino acid
  UNSURE (23)..(23): Xaa can be any one of Asn, Gln, Lys, Leu or no amino acid
  UNSURE (24)..(24): Xaa can be any one of Ser, Leu, Gln, Arg or no amino acid
  UNSURE (25)..(25): Xaa can be any one of Val, Ile, Ala, Arg, Tyr or no amino acid
XXXXHVFKGEGFXXXTDERHXXXXX

SEQ ID NO: 184 - DNA, 52 bp, Artificial sequence
  primer 1
ggggacaagtttgtacaaaaaagcaggcttaaacaatgagctggctcgggaa

SEQ ID NO: 185 - DNA, 49 bp, Artificial sequence
  primer 2
ggggaccactttgtacaagaaagctgggtgttctggttcaaacttgccc

SEQ ID NO: 186 - DNA, 56 bp, Artificial sequence
  primer 3
ggggacaagtttgtacaaaaaagcaggcttaaacaatgggctcttcagcttcttct

SEQ ID NO: 187 - DNA, 53 bp, Artificial sequence
  primer 4
ggggaccactttgtacaagaaagctgggttttgatcatcttacttccttggtt

SEQ ID NO: 188 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 189 - DNA, 51 bp, Artificial sequence
  primer 5
ggggacaagtttgtacaaaaaagcaggcttaaacaatgggcgccgcgccgt

SEQ ID NO: 190 - DNA, 55 bp, Artificial sequence
  primer 6
ggggaccactttgtacaagaaagctgggtactactggggcttaaacttcagagac

SEQ ID NO: 191 - DNA, 53 bp, Artificial sequence
  primer 7
ggggacaagtttgtacaaaaaagcaggcttaaacaatgcaggtcctcgtcgtc

SEQ ID NO: 192 - DNA, 50 bp, Artificial sequence
  primer 8
ggggaccactttgtacaagaaagctgggtgtgcttgagggaagactgact

SEQ ID NO: 193 - DNA, 1341 bp, Oryza sativa
atggcggcgacgatcgtgtccgtcaaggcgcgccagatcttcgacagcaggggcaaccccaccgtcgaggtcgatgtgtgctgctcagatggaacctttgcaagggctgcagttcccagtggtgcatcaactggtgtctatgaagctctcgaattgagggacggtggatctgattacttgggaaagggtgtttccaaggctgtcgacaatgtgaactcggttattgccccagctctgattggcaaggaccctacgtcacaggctgagcttgataacttcatggttcagcagcttgatggaaccaaaaatgagtgggggtggtgcaagcagaagcttggtgctaatgcaatcctggctgtgtcactggccatttgcaaagctggagctatcatcaagaagattcctctgtaccagcacattgccaaccttgctggaaacaagcaactggttttgcccgtacctgcattcaacgtcattaacggtggatcacatgctggaaacaagcttgccatgcaggagttcatgatccttcctactggggccgcttcattcaaggaggccatgaagatgggtgttgaagtgtaccacaacctgaagtctgttatcaagaagaagtatggtcaggatgccaccaatgttggtgatgaaggtggttttgctcctaacattcaggaaaacaaggagggtcttgagctcttgaagactgcaattgaaaaggctggatacactggcaaggttgtcattggaatggatgttgctgcttcggaattctacaatgacaaggacaaaacctatgaccttaacttcaaggaggagaacaatgatggttcacaaaagatatctggtgatagcctgaagaatgtatacaagtcatttgtcagtgaataccccattgtctcgattgaggatccgtttgaccaggatgactgggaacactatgctaagatgaccgctgaaattggagagcaagtgcagattgtcggtgatgacctccttgtcaccaacccaacaagggtggcaaaggcaatccaggagaagtcatgcaatgctcttctgctgaaggttaaccaaattggatctgtcactgagagtattgaggccgtgaagatgtcaaagcgtgctggctggggtgtgatgaccagccacaggagtggtgagactgaggataccttcattgctgatttggctgttggtttggccacgggtcagatcaagactggagcaccctgccgatcagagcgccttgccaaatacaaccagcttcttaggattgaggaggagcttggtgcggctgctgtctacgctggtgccaagttccgcgcacccgtggagccctactaa

SEQ ID NO: 194 - protein, 446 aa, Oryza sativa
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 195 - DNA, 1338 bp, Oryza sativa
atggcggcgaccatccagagcgtgaaggcccgccagatcttcgacagccgtggcaaccccaccgtcgaggttgatatttgctgctcggatggaacatttgcgagggctgctgtgcctagcggtgcatctactggtgtatatgaagctttggaattgagggatggtggctctgattacttgggaaagggtgtcctcaaggctgttgacaatgtgaactctattattggaccagcattgattggcaaggaccctacagaacagactgtcattgacaacttcatggttcagcaactggatggaaccaaaaacgagtggggctggtgcaagcaaaagcttggtgctaatgctatcctggctgtctcacttgctctatgcaaagccggagctattatcaagaaaattccgttgtatcaacacattgctaaccttgctggtaacaagcaacttgttttgcctgtgcctgctttcaatgtcatcaatggtggatcacatgctggaaacaagctagctatgcaggagttcatgatcctccctactggtgcttcatctttcaaggaggctatgaagatgggtgttgaagtataccataacttaaagtctgttatcaagaagaagtatgggcaagatgctactaatgttggtgatgaaggtggttttgctccaaacattcaggaaaacaaggagggccttgagcttttgaagactgcaattgaaaaggctggatacactggcaaggttgtcattgggatggatgttgctgcttcagagttctacactgaggaccaaacctatgatcttaacttcaaggaagagaacaatgatggttcccagaagatatctggagatagcctgaagaatgtgtacaagtcatttgttagtgaatacccaattgtctcgatcgaagacccatttgatcaggatgactgggttcactatgctaagatgaccgaagaaattggagatcaagtgcagattgttggagatgatctccttgtcaccaacccaactagggtagccaaggcaattaaggacaaggcctgcaatgctcttctccttaaggttaaccaaattggatctgttactgagagcattgaggctgtcaagatgtcaaaacgtgctggctggggtgtgatgaccagtcacaggagtggtgaaactgaggatacattcattgctgatctggcagttggtttatccacgggccagatcaagactggagctccttgcagatctgagcgccttgccaagtacaaccagcttcttaggatcgaggaggagcttggtgctgctgccgtctatgccggagccaaattccgtgcaccagtggagccctactag

SEQ ID NO: 196 - protein, 445 aa, Oryza sativa
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTGQIKTGAPCRSERLAKYNQLLRIEEELGAAAVYAGAKFRAPVEPY

SEQ ID NO: 197 - DNA, 1182 bp, Oryza sativa
atgtctgccttcatctttacatgccgtttgttatttcaacaggctgttgacaatgtgaactctattattggaccagcattgattggcaaggaccctacagaacagactgtcattgacaacttcatggttcagcaactggatggaaccaaaaacgagtggggctggtgcaagcaaaagcttggtgctaatgctatcctggctgtctcacttgctctatgcaaagccggagctattatcaagaaaattccgttgtatcaacacattgctaaccttgctggtaacaagcaacttgttttgcctgtgcctgctttcaatgtcatcaatggtggatcacatgctggaaacaagctagctatgcaggagttcatgatcctccctactggtgcttcatctttcaaggaggctatgaagatgggtgttgaagtataccataacttaaagtctgttatcaagaagaagtatgggcaagatgctactaatgttggtgatgaaggtggttttgctccaaacattcaggaaaacaaggagggccttgagcttttgaagactgcaattgaaaaggctggatacactggcaaggttgtcattgggatggatgttgctgcttcagagttctacactgaggaccaaacctatgatcttaacttcaaggaagagaacaatgatggttcccagaagatatctggagatagcctgaagaatgtgtacaagtcatttgttagtgaatacccaattgtctcgatcgaagacccatttgatcaggatgactgggttcactatgctaagatgaccgaagaaattggagatcaagtgcagattgttggagatgatctccttgtcaccaacccaactagggtagccaaggcaattaaggacaaggcctgcaatgctcttctccttaaggttaaccaaattggatctgttactgagagcattgaggctgtcaagatgtcaaaacgtgctggctggggtgtgatgaccagtcacaggagtggtgaaactgaggatacattcattgctgatctggcagttggtttatccacgggccagatcaagactggagctccttgcagatctgagcgccttgccaagtacaaccagcttcttaggatcgaggaggagcttggtgctgctgccgtctatgccggagccaaattccgtgcaccagtggagccctactag

SEQ ID NO: 198 - protein, 393 aa, Oryza sativa
MSAFIFTCRLLFQQAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYTEDQTYDLNFKEENNDGSQKISGDSLKNVYKSFVSEYPIVSIEDPFDQDDWVHYAKMTEEIGDQVQIVGDDLLVTNPTRVAKAIKDKACNALLLKVNQIGSVTESIEAVKMSKRAGWGVMTSHRSGETEDTFIADLAVGLSTGQIKTGAPCRSERLAKYNQLLRIEEELGAAAVYAGAKFRAPVEPY

SEQ ID NO: 199 - DNA, 1437 bp, Oryza sativa
atgtcggtgcaggagtacctggagaagcacctgctgtcgcgcaagatcgaggaggccgtgaacgcggcggtccgcgccaaggcccccgacccggtgctcttcatctccaaccacatgcgccgggcggcgccggccgtgatcacgagcgtgcgggcgcgccagatcctcgacggccgcggggagcccgccgtggaggtcagcctccacaccaacaaggccgtgcaccgcgcctccgcggccgccgcggacgcccccgagggcgccgccgccgacgccgtcagggacgccgagaagcggaagctgctcgccagggcggtcgccgatgcggtgcgggtgatcaacgacaaggtgtcggaggcgcttgtgggaatggatccgcagcagcagtcgcagatcgaccaggccatcatggacttggacaaggcgcatcacaaggctgagattggagtgaattctatgttggctgtatcaattgcagcttgtaaagcaggtgctgctgaaaaagaggttccattgtacaagcatatagcagaacttgttgggaaaagcgctacgacacttcccatccctgcaattacagtcattaatggaggaacacatgctggaaacagtctccctattcaagaaattatgatccttcctgttggtgccaaaaactttgaagaagcaatgcagatgggttctgagacatatcatcatctgaaggatatcatcttggagaaatatggttcaaacagctgcaacataggtgatgatggtggatttgctccaaatatttccagcataaccgaaggcttggatcttgtcattgaggcaataaatagagctggatataatggaaggatcaagctagcaattgatgtcgccgctaccgatttttgcatgggaaataagtatgacatggagttcaagtttgcagagaaatcagggcagggcttcaaaactgcagatgatttgattgagatttatagccagctttgttcagagtacccacttgtctcaatcgaacagccctttgataaagatgactgggagcattcgaagaagtttaccaccctagagctgtgccaggttgtaggtgatgacttattgatgtcagatcccgaacgcattaagcgggcagtaaatgagtatacctgcaatgctcttgttctcaaggctaatcaagtaggcactgtcacggaagccatagaggttgtgagacaggcaaaggatgctcattggggcgtaatggtgtcacataggtccggggacactgatgattctttcattgctgacttggctgttggtgctgctgctggacagatcaaagcgggtgctccttgccgtggagaatgtctcagtaaatacaatcagctgcttagaatagaggaagaacttggaagtgacggtgtttatgcaggggaaaattggagaaccaccgcaagcacaagctga

SEQ ID NO: 200 - protein, 478 aa, Oryza sativa
MSVQEYLEKHLLSRKIEEAVNAAVRAKAPDPVLFISNHMRRAAPAVITSVRARQILDGRGEPAVEVSLHTNKAVHRASAAAADAPEGAAADAVRDAEKRKLLARAVADAVRVINDKVSEALVGMDPQQQSQIDQAIMDLDKAHHKAEIGVNSMLAVSIAACKAGAAEKEVPLYKHIAELVGKSATTLPIPAITVINGGTHAGNSLPIQEIMILPVGAKNFEEAMQMGSETYHHLKDIILEKYGSNSCNIGDDGGFAPNISSITEGLDLVIEAINRAGYNGRIKLAIDVAATDFCMGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 201 - DNA, 1341 bp, Oryza sativa
atggcggtgacgatccagtccgtgaaggcgaggcagatcttcgacagccgcgggaaccccacggtggaggtggacgtgggactcagcgatggcagcttcgcgaggggcgccgtgccgagcggtgcttccaccggaatatatgaggccttggagttaagagatggaggatccgactatcttggcaaaggtgtactcaaggctgtgagcaatgtaaacactattattgggccagcactcatcggaaaggatcccactgagcaagttgacattgataacttcatggttcaacagcttgatggaacctccaacaactggggctggtgcaaacaaaagcttggagcaaatgctattcttgctgtttcacttgctgtgtgcaaagcaggagccatggtgaagaagattcccctttaccagcacattgcaaatcttgctggaaacaagactctcgtgctgcctgtacccgctttcaatgtgatcaatggaggatcccatgctggaaacaaacttgccatgcaggagttcatgatcctccctactggtgcatcctctttcaaggaggccatgaagatgggagttgaggtgtaccaccacttgaagagtataatcaagaaaaagtatggccaagatgccacaaatgtgggggatgaaggtggctttgctcctaacattcaggaaaacaaagagggcctcgaactgttgaaggccgcaatagctaaggctggctacacaggcaaagtggtcataggaatggatgttgcagcttctgaattttacagtgaaaaggacaagacttacgatcttaacttcaaggaggataacaacgacggttcacacaaaatttcaggtgacagcctgaaagatgtgtacaagtcctttgtttctgagtaccctattgtgtcgatcgaagatccattcgatcaggatgactgggctacctatgccaagcttactgatgagattggacagcaagtgcagattgttggggatgaccttcttgttactaatcccacaagggttgccaaggcaattagtgaaaagacttgcaatgctcttctcttgaaggtgaatcaaataggctcagttactgagagcattgaggctgttagaatgtccaagcgtgctggatggggagtgatggcaagccataggagtggtgagacagaggataccttcattgctgacctctcagttggtctgtctacgggtcaaattaagacaggagctccctgtcggtcagagcgtctggctaaatacaaccagctgctcaggatagaagaagagctgggcgatgctgcagtttacgctggagaaaaattcagagcccctgtggagccgtactaa

SEQ ID NO: 202 - protein, 446 aa, Oryza sativa
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 203 - DNA, 1440 bp, Oryza sativa
atggcccaccgcctcctcctccccaccaaccccctcctgccccccggcaccggcaccgccaccccgcggcggcgccccgtcgccgccaccgtccgcgcggcgctcgcgacgtcggcggaggaggcgagggcggcgacgggggcggaggtggtgcggtcgatccgggcgaggcagatcgtggacagccgcgggaaccccaccgtggaggtcgacctcgtcgccggggacgggcggctgcaccgctccgcggtgcccagcggcgcatccacggggatctacgaggcgctcgagctccgcgacggggacggggcggcgtacggcgggaagggcgtgctcaacgccgtccgcaacatcaacgaggtcatcgcgcccaagctcgtcggcgtcgacgtcaggaaccagagtgatgttgatgcaatcatgctagacattgatggaactccgaacaagtcaaaattgggtgccaatgctattcttggagtctctttaagcgtatgcagggctggtgctggtgcaaaggaagttcctttatataaacatattcaggagttggctggaacaaaggagcttgtcatgcccgtcccagctttcaatgtaataaatggaggtagccatgcgggcaacaatctggccatgcaggagttcatgcttttacctgtgggagcatcttcattttctgaggctcttcgcatgggtagtgaagtttaccatgccctaaagggcatcattaaggcgaaatatggtcaagatgcatgcaatgttggagatgaaggtggctttgctcctaatgttcaagacaacagagaaggccttgtcttgcttatggatgccattgagaaggcaggctactctggaaagattaaaattggaatggatgttgcagcatcagagtttcttacaaaggatggaagctatgacttaaactttaagaatcagcctaatgatggagctcatgttctttcagcccagcgtctctgtgatctgtacaaagaatttgtcaaggatttccccattgtatcaattgaggaccctttcgatcaagatgactggagctcatgggcatcattgcagtcttcagttaatatccaaattgtgggggatgatttactcgtcacgaacccaaaacgtattgcagaggctattggcaagaaggcttgcaatgctcttttgctgaaggttaatcaaattggcactgtcactgaatcaattcaagctgctcttgattcaaaagctgctggttggggcgtgatggtcagccacaggagtggggaaacggaagataatttcatcgcagatctggctgttggtttagcaagtggtcagatcaaaactggtgctccatgccgtagcgagagactggcaaagtacaatcagcttctgcggatcgaaatggagctaggcaatgtgcgctatgctggggaggcattcaggtctccctaa

SEQ ID NO: 204 - protein, 479 aa, Oryza sativa
MAHRLLLPTNPLLPPGTGTATPRRRPVAATVRAALATSAEEARAATGAEVVRSIRARQIVDSRGNPTVEVDLVAGDGRLHRSAVPSGASTGIYEALELRDGDGAAYGGKGVLNAVRNINEVIAPKLVGVDVRNQSDVDAIMLDIDGTPNKSKLGANAILGVSLSVCRAGAGAKEVPLYKHIQELAGTKELVMPVPAFNVINGGSHAGNNLAMQEFMLLPVGASSFSEALRMGSEVYHALKGIIKAKYGQDACNVGDEGGFAPNVQDNREGLVLLMDAIEKAGYSGKIKIGMDVAASEFLTKDGSYDLNFKNQPNDGAHVLSAQRLCDLYKEFVKDFPIVSIEDPFDQDDWSSWASLQSSVNIQIVGDDLLVTNPKRIAEAIGKKACNALLLKVNQIGTVTESIQAALDSKAAGWGVMVSHRSGETEDNFIADLAVGLASGQIKTGAPCRSERLAKYNQLLRIEMELGNVRYAGEAFRSP

SEQ ID NO: 205 - DNA, 1443 bp, Oryza sativa
atgtctcgcatccatcgaaaccccactttattagcaccaaccccgtctccttcctccattcctccgctgctagaaccttctagaagctctcctcctcctcccatggcggcgacgatcgtgtccgtcaaggcgcgccagatcttcgacagcaggggcaaccccaccgtcgaggtcgatgtgtgctgctcagatggaacctttgcaagggctgcagttcccagtggtgcatcaactggtgtctatgaagctctcgaattgagggacggtggatctgattacttgggaaagggtgtttccaaggctgtcgacaatgtgaactcggttattgccccagctctgattggcaaggaccctacgtcacaggctgagcttgataacttcatggttcagcagcttgatggaaccaaaaatgagtgggggtggtgcaagcagaagcttggtgctaatgcaatcctggctgtgtcactggccatttgcaaagctggagctatcatcaagaagattcctctgtaccagcacattgccaaccttgctggaaacaagcaactggttttgcccgtacctgcattcaacgtcattaacggtggatcacatgctggaaacaagcttgccatgcaggagttcatgatccttcctactggggccgcttcattcaaggaggccatgaagatgggtgttgaagtgtaccacaacctgaagtctgttatcaagaagaagtatggtcaggatgccaccaatgttggtgatgaaggtggttttgctcctaacattcaggaaaacaaggagggtcttgagctcttgaagactgcaattgaaaaggctggatacactggcaaggttgtcattggaatggatgttgctgcttcggaattctacaatgacaaggacaaaacctatgaccttaacttcaaggaggagaacaatgatggttcacaaaagatatctggtgatagcctgaagaatgtatacaagtcatttgtcagtgaataccccattgtctcgattgaggatccgtttgaccaggatgactgggaacactatgctaagatgaccgctgaaattggagagcaagtgcagattgtcggtgatgacctccttgtcaccaacccaacaagggtggcaaaggcaatccaggagaagtcatgcaatgctcttctgctgaaggttaaccaaattggatctgtcactgagagtattgaggccgtgaagatgtcaaagcgtgctggctggggtgtgatgaccagccacaggagtggtgagactgaggataccttcattgctgatttggctgttggtttggccacgggtcagatcaagactggagcaccctgccgatcagagcgccttgccaaatacaaccagcttcttaggattgaggaggagcttggtgcggctgctgtctacgctggtgccaagttccgcgcacccgtggagccctactaa

SEQ ID NO: 206 - protein, 480 aa, Oryza sativa
MSRIHRNPTLLAPTPSPSSIPPLLEPSRSSPPPPMAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 207 - DNA, 1341 bp, Zea mays
atggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaa

SEQ ID NO: 208 - protein, 446 aa, Zea mays
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 209 - DNA, 1341 bp, Zea mays
atggcggtcacgatcacgtgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaa

SEQ ID NO: 210 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 211 - DNA, 1671 bp, Zea mays
atggcacgcgagccccacctgccacctccgatccgtcgcctccaccaaccccgccttattcaaaaaatttattcgccgaaaccccttgccaatgccacctcgccgcctccgcccgacccagcaaaaaggcacgacgacctctacctctacctcgccgccaccgtcaccgtggcccgccgccatataagtaaaccctcgcctcgtcctcctcccaggctcgccaccctccgcctccgacacatggcccacccgcacctcgtgctcccctccccgaagtccctcctccccgccgccgcaactccatcgcgccgcgccgtcgccatccgcgcggcgatctccaccgctttgtctccggccaaggcggcagctggagcagaggcggtgcgatcgatccgcgcgcggcagatcgtggacagccgcgggaaccccaccgtcgaggtcgacctcgtcgccggggacggacgcctccaccgctccgcggtgcccagcggggcgtccacggggatctacgaggcgctggagctccgcgacggtgacaaggccgtatacggcgggaagggcgtactccaagctgtgcgcaacatcaacgaggttatcgcgcctaagctcataggcgtcgatgtgaggaaccaaagcgatgttgatgcagtcatgctagacattgatggaactcagaataaatcgaagttgggtgccaatgctattctcggagtctccttgagtgtatgtagggcaggcgctggtgcaaagggagttcctctgtataaacatattcaggagctagcaggaattaaggagcttgtcatgcctgttcctgcttttaatgtaataaatggaggtagccatgctggcaacaatctggccatgcaggagttcatgattttacctgttggagcaactacatttgctgaagctcttcgtatgggcagcgaagtttaccatgtcctgaagagcatcattaagtcaaaatatggtcaagatgcatgcaatgtcggagatgaaggaggttttgctcctaatgttcaagacaacagagagggtcttatcttgcttatggatgccattgagaaggcaggctacactggaatgatcaaaattggaatggatgttgcggcatcagagttccttacaaaggatgggaactatgatctaaactttaagaatcagcctaatgatggagtccatgttctttcagcccagcatctgggtgatctgtacagagattttgtcaaggatttccctattgtatcaattgaggacccttttgatcaggatgactggagttcatgggcatcattgcagtcctcagttggtatccaaattgtgggtgatgatttacttgtcacaaacccaaaacgaattgcagacgctattgacaggaaggcttgcaatgctcttttattaaaggtcaaccagattggtactgtcactgaatcaattcaagctgccctggattcaaaagctgctggttggggtgtgatggtcagccacagaagtggtgaaaccgaagacaacttcatcgcagatttggctgttggcttagcaagtgggcagattaaaactggggctccatgccgcagcgagaggctggccaaatacaatcagcttttgcggattgaagaggggcttggcaacgtgcgctatgcaggggaggcattcaggtctccataa

SEQ ID NO: 212 - protein, 556 aa, Zea mays
MAREPHLPPPIRRLHQPRLIQKIYSPKPLANATSPPPPDPAKRHDDLYLYLAATVTVARRHISKPSPRPPPRLATLRLRHMAHPHLVLPSPKSLLPAAATPSRRAVAIRAAISTALSPAKAAAGAEAVRSIRARQIVDSRGNPTVEVDLVAGDGRLHRSAVPSGASTGIYEALELRDGDKAVYGGKGVLQAVRNINEVIAPKLIGVDVRNQSDVDAVMLDIDGTQNKSKLGANAILGVSLSVCRAGAGAKGVPLYKHIQELAGIKELVMPVPAFNVINGGSHAGNNLAMQEFMILPVGATTFAEALRMGSEVYHVLKSIIKSKYGQDACNVGDEGGFAPNVQDNREGLILLMDAIEKAGYTGMIKIGMDVAASEFLTKDGNYDLNFKNQPNDGVHVLSAQHLGDLYRDFVKDFPIVSIEDPFDQDDWSSWASLQSSVGIQIVGDDLLVTNPKRIADAIDRKACNALLLKVNQIGTVTESIQAALDSKAAGWGVMVSHRSGETEDNFIADLAVGLASGQIKTGAPCRSERLAKYNQLLRIEEGLGNVRYAGEAFRSP

SEQ ID NO: 213 - DNA, 1341 bp, Hordeum vulgare
atggccgccacgatccagtccgtcaaggcccgccagatcttcgacagccgcggcaaccccaccgtcgaggttgatgtgtgctgctcagatggaaccttcgccagggccgccgttcccagcggtgcatcaactggtgtttatgaagctttggaactgagggacggtggatctgactacttgggaaagggtgtttcgaaggctgtcgacaatgtgaactcgattatcgcgccagctttgattggcaaggaccctacagctcaaactgagctcgacaactttatggttcagcagcttgatggaaccaaaaacgagtggggttggtgcaagcagaagctcggtgctaatgctatcctggctgtgtcactagctgtttgcaaagctggagccagcgtcaagaagattccgctgtaccagcacattgccaaccttgctggcaacaagcaattggttttgcctgttcctgcattcaatgttatcaatggtggttcccatgctggaaacaagcttgctatgcaggagttcatgattcttcctactggagctgcctcattcaaggaggcaatgaagatgggcgttgaagtgtaccacaacttgaagtctgttatcaagaagaagtatgggcaggatgccaccaatgttggagatgaaggtggttttgctcctaacattcaggagaacaaggagggccttgagctcttgaagactgcaattgaaaaggctggatacaccggcaaggttgtcattggaatggacgttgctgcttcagagttctacaatgacaaggacaaaacctatgacctcaacttcaaggaagagaacaacgatggttcccagaagatatctggagatagcctgaagaacgtatacaagtcattcgtgagtgagtaccctattgtgtcgattgaggacccatttgaccaggatgactgggttcactatgctaagatgactgaggaatgcggagagcaagttcagattgttggtgatgaccttctagtcaccaacccaaccagagttgcgaaggctatccaggagaagtcatgcaatgctcttctgctgaaggttaaccaaattggatccgtcactgagagtatcgaggctgtgaagatgtcaaagcatgctggctggggtgtgatgaccagtcacaggagtggtgagactgaggacacattcattgctgatttggctgttggtttgtccacgggtcagatcaagaccggggctccctgccgctcagagcggcttgccaagtacaaccagcttctgaggatcgaggaggagctaggcgctgccgctgtgtatgccggcctcaagttccgtgcaccggtggagccatactag

SEQ ID NO: 214 - protein, 446 aa, Hordeum vulgare
MAATIQSVKARQIFDSRGNPTVEVDVCCSDGTFARAAVPSGASTGVYEALELRDGGSDYLGKGVSKAVDNVNSIIAPALIGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 215 - DNA, 1338 bp, Glycine max
atggcaacgatcaaggccgtgaaagctcgccagatcttcgacagccgtggaaatccaaccgtcgaagttgacgttattctcagcgatggaagcttccacagagccgccgtgcctagcggtgcttcaacaggtgtttatgaggctttggaattaagggatggaggctcagactacctcgggaaaggtgttctcaaggctgtggagaatgttaattcaattatagcacctgctctgcttggcaaggacccaacgaagcagactgaaattgacaattttatggtacagcagcttgatggaactgttaatgaatgggggtggtgcaagcagaagcttggagccaatgctattttggcagtgtcacttgctgtctgcaaggctggtgctgcagtgaagaaaattcctctgtacaagcacattgccaatctggctggaaacaagactttggtactgcctgtaccttcattcaatgttatcaatggaggctcacatgctggaaataagctagcaatgcaggaatttatgattctccctgttggggcatcttccttcaaagaagccatgaaaatgggcgtagaagtataccatcatctaaaggctgttattaaaaagaaatacggtcaggatgctactaacgttggtgatgaaggtggctttgctcctaatatccaggaaaaccaagaaggtcttgagcttctgaagactgccattgccaaagctggttacactggaaaggttgtaattgggatggatgttgctgcttcagaattttatgataacaaggacaaaacctatgacttgaattttaaggaagagaataatgatggatcacagaaaatctcaggagacagcttaaagaatgtgtacaaatcatatgtgacagattatccaattgtgtccattgaggatccatttgatcaggatgactgggagcactatgcaaaattaacagctgaagttggccagcaagtgcagattgttggtgatgatctccttgtcaccaacccgaagcgggtggagaaagcaatcaaggagaaggcttgcaatgcccttctgttgaaggtgaatcaaattggtagtgtaactgaaagtattgaagctgtgagaatgtctaaacaagctggttggggtgtcatggctagccacaggagtggtgaaactgaggataccttcattgctgacctctcagttggattagcaactggtcagatcaagactggagctccctgccgatctgaaaggcttgccaagtacaaccagctcctgaggattgaggaggaactgggttctgcggctgtctatgctggtgccaaattcagagccccagtggaaccctattga

SEQ ID NO: 216 - protein, 445 aa, Glycine max
MATIKAVKARQIFDSRGNPTVEVDVILSDGSFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENQEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 217 - DNA, 1335 bp, Glycine max
atggctaccatcgttagcatcaaggcccgccagatcttcgacagtcgtggcaatccaactgtcgaggtggatttgacttgctccgatggtacttttgccagagctgctgttccaagtggtgcatccactgggatttatgaggcccttgaattgagagatggaggatctgactaccttggaaagggtgtatcaaaggctgttgacaatgtgaacaccgtcattggccctgctttgattggcaaggacccaactgagcagactgctattgacaacttaatggttcaacagcttgatggaactgttaacgaatggggttggtgcaagcaaaagctaggagcaaatgccatattggcagtgtctcttgcagtctgcaaagctggtgctagcgtcctgaaaattcctctttacaagcatattgcaaatatcgcgggtaacaaaaagttggttttgcctgttcctgctttcaatgtcattaatggtggatcacatgctggaaacaaacttgctatgcaggagtttatggttcttcccgtgggagcttcctctttcaaggaagccatgaagatgggtgtagaagtatatcacaatttgaagtctgtgattaagaagaaatatggtcaagatgcagtaaatgttggtgacgaaggtggctttgcccctaacatccaggaaaacaaggaaggtttggaattgctgaaaactgccattgccaaagctggttacacaggcaaagttgtcattggaatggatgttgcagcttctgaattctacaaggaagataaaacatacgatttgaacttcaaggaagataacaatgatggctcccagaggatctctggagatgctttgaaagatctgtacaagtcatttgtgtcagagtacccaattgtttcaattgaggatccatttgaccaggatgactgggagcactatgctaagctaactgctgaggttggagccaatgtacaaattgttggtgatgatctcttggttaccaaccccaagagggttcagaaggcaattgatactaaagcatgcaatgctcttctcctcaaggtcaaccaaattggttctgtgactgagagtattgaagctgtcaggatgtccaaaaaagctggatggggtgtcatggccagtcacagaagtggagagactgaggataccttcattgctgacctttctgttggtttggctacgggtcaaattaagactggagctccatgcaggtctgagcgtcttgctaaatataaccagctcttgagaattgaggaggagcttggtgctgaagcagtgtacgccggagctaacttccgtacccccgttgaaccctactaa

SEQ ID NO: 218 - protein, 444 aa, Glycine max
MATIVSIKARQIFDSRGNPTVEVDLTCSDGTFARAAVPSGASTGIYEALELRDGGSDYLGKGVSKAVDNVNTVIGPALIGKDPTEQTAIDNLMVQQLDGTVNEWGWCKQKLGANAILAVSLAVCKAGASVLKIPLYKHIANIAGNKKLVLPVPAFNVINGGSHAGNKLAMQEFMVLPVGASSFKEAMKMGVEVYHNLKSVIKKKYGQDAVNVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 219 - DNA, 1434 bp, Arabidopsis thaliana
atggctttgactacaaaacctcaccatcttcagagatctttcctctctccgtcgcgtgtttccggcgaacgatatttggaatctgcgccatcatgtctgagattccgtcgcagcggtgtccaatgctcggtggtggctaaggagtgcagagtgaaaggagtgaaagcgagacagattattgatagtagagggaatccgacggtggaggttgatctgattaccgatgatctgtatcgttcggctgttccaagtggtgcatctaccgggatctacgaagcgcttgagcttagagatggagacaagagcgtctatggtggtaaaggtgtattacaggctattaaaaacatcaatgaacttgtggctccaaaactcattggagttgacgttaggaaccaagctgatgtcgatgctcttatgctggaactggatgggaccccaaacaagtcgaaactcggggctaatgcgatattaggagtgtcattgagcgtttgcagggcaggtgctggagctaaaggagtgcctttgtacaaacacatccaggaaacatcaggaacaaaggagcttgtcatgccagttcctgcattcaatgtgatcaatggaggcagtcatgctgggaatagtttggctatgcaagagtttatgatactacctgtaggagctacctcattctcggaggccttccagatgggaagtgaagtttatcatacattgaaggggataatcaaaactaagtatggtcaagatgcttgtaatgtcggagatgaaggagggtttgcgccgaatgttcaagataacagagagggactagttctgctcatagatgcaattgaaaaggccggttacactggaaagatcaaaataggaatggatgttgctgcatcagaatttttcatgaaagatggtagatacgatttgaacttcaagaaacagccaaacgatggagctcacgtactgtcagccgagagtcttgctgacctctacagagaattcatcaaggatttcccaattgtctctatcgaagatccttttgaccaggatgattggagctcatgggcttcattgcaatcctctgtggatatccaactcgtgggagatgacttgttagtcactaacccgaagaggatagctgaagctattaagaaacagtcttgcaatgctctactcttgaaggttaaccagattgggacagtcactgagtcaattcaagcagcacttgactcaaaagctgcaggctggggtgtgatggttagtcacaggagtggcgagacagaggataacttcatcgcagatctctctgttggtttagcaagcggacagatcaaaactggtgctccatgccgaagtgaacgattgtcaaaatacaaccagcttctccgtatcgaagaggaactcggcaatgtgcgctacgccggtgaagctttccgatcaccatga

SEQ ID NO: 220 - protein, 477 aa, Arabidopsis thaliana
MALTTKPHHLQRSFLSPSRVSGERYLESAPSCLRFRRSGVQCSVVAKECRVKGVKARQIIDSRGNPTVEVDLITDDLYRSAVPSGASTGIYEALELRDGDKSVYGGKGVLQAIKNINELVAPKLIGVDVRNQADVDALMLELDGTPNKSKLGANAILGVSLSVCRAGAGAKGVPLYKHIQETSGTKELVMPVPAFNVINGGSHAGNSLAMQEFMILPVGATSFSEAFQMGSEVYHTLKGIIKTKYGQDACNVGDEGGFAPNVQDNREGLVLLIDAIEKAGYTGKIKIGMDVAASEFFMKDGRYDLNFKKQPNDGAHVLSAESLADLYREFIKDFPIVSIEDPFDQDDWSSWASLQSSVDIQLVGDDLLVTNPKRIAEAIKKQSCNALLLKVNQIGTVTESIQAALDSKAAGWGVMVSHRSGETEDNFIADLSVGLASGQIKTGAPCRSERLSKYNQLLRIEEELGNVRYAGEAFRSP

SEQ ID NO: 221 - DNA, 1428 bp, Arabidopsis thaliana
atgtctgtgcaagagtatttagacaagcatatgctttctcggaaaatcgaagacgccgttaatgccgccgtaagggctaaaacctcagatcccgttctcttcatcgctaatcatctgaagaaagctgtatcatctgtgataacgaaggttaaagcacgacagatccttgacagcagaggaattccaacagttgaagttgatctgcacacgaacaaaggcgtttttcgtgcttctgttcccagtggtgattcttctggaacgtatgaagctattgagctacgtgatggagacaaaggaatgtatcttggaaacagtgtggctaaagctgttaagaacataaatgaaaaaatttctgaggcgttgattggtatggacccaaaacttcagggtcagatagatcaggctatgatagatttggataaaactgaaaagaagagtgaacttggtgctaatgctatacttgctgtgtcaattgcggcatgcaaggctggagctgctgagaaagaggtccctttgtgcaagcatctttctgatcttagtggcagagcaaacatggtgttacctgtacctgcgttcactgttttgagtggtgggaagcatgcttcgaatacttttgccattcaggaaattatgattctcccaattggagcaagtagatttgaggaggccctgcaatggggatctgagacatatcatcatttaaaggctgtcatttcagaaaagaatggtggtttgggatgtaatgttggtgaagatggtggtcttgctccagatatctcgagcctcaaggaaggtttggagcttgtaaaagaagctatcaaccgaacagggtacaatgataagataaagatagccattgatattgccgccactaatttttgtttaggtaccaagtatgatttagatatcaagtctccaaataaatctgggcaaaatttcaagtcagcggaagatatgatagatatgtacaaagaaatttgtaatgattatccaattgtgtctatagaagacccttttgacaaggaggactgggaacacaccaagtatttttcgagtcttggaatatgtcaggtggtaggtgacgatttgttgatgtcaaattcaaaacgagttgagcgtgccatacaggagtcttcttgtaatgctcttcttctcaaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccagttgctacggatagaggaagagcttggggatcaagcagtgtatgctggagaagattggaagctatctctctaa

SEQ ID NO: 222 - protein, 475 aa, Arabidopsis thaliana
MSVQEYLDKHMLSRKIEDAVNAAVRAKTSDPVLFIANHLKKAVSSVITKVKARQILDSRGIPTVEVDLHTNKGVFRASVPSGDSSGTYEAIELRDGDKGMYLGNSVAKAVKNINEKISEALIGMDPKLQGQIDQAMIDLDKTEKKSELGANAILAVSIAACKAGAAEKEVPLCKHLSDLSGRANMVLPVPAFTVLSGGKHASNTFAIQEIMILPIGASRFEEALQWGSETYHHLKAVISEKNGGLGCNVGEDGGLAPDISSLKEGLELVKEAINRTGYNDKIKIAIDIAATNFCLGTKYDLDIKSPNKSGQNFKSAEDMIDMYKEICNDYPIVSIEDPFDKEDWEHTKYFSSLGICQVVGDDLLMSNSKRVERAIQESSCNALLLKVNQIGTVTEAIEVVKMARDAQWGVVTSHRCGETEDSFISDLSVGLATGVIKAGAPCRGERTMKYNQLLRIEEELGDQAVYAGEDWKLSL

SEQ ID NO: 223 - DNA, 1335 bp, Arabidopsis thaliana
atggctactatcaccgttgttaaggctagacagatcttcgacagtcgtggtaatcccaccgttgaggttgatatccacacgtcaaatggtattaaggttacagcagctgttccaagtggagcttccactggtatctatgaggctcttgagctgagggatggaggatctgactaccttggaaagggtgtatctaaggctgttggcaatgtgaacaacatcatcgggccagcacttattggaaaggacccaactcagcagactgctattgacaacttcatggtccatgaacttgacggaacccaaaacgagtgggggtggtgcaagcaaaagcttggagccaatgcgattcttgctgtgtctcttgctgtctgcaaagctggggctgttgtcagcggcattcctctatacaagcacattgccaaccttgctggtaaccccaagattgtgctaccagttcctgccttcaacgtcatcaatggtggatcccatgccggaaacaagcttgctatgcaggagtttatgatcctccctgttggagctgcttctttcaaggaagccatgaagatgggtgtggaagtttaccaccacttgaagtctgtgattaagaagaagtacggccaggatgccacaaatgttggtgatgaaggtgggtttgcaccaaacattcaggagaacaaggagggtcttgaattgctcaagactgctatcgagaaggctggatacactggaaaggttgtcattggaatggatgttgccgcttcagagttctactcagaagacaagacctacgacttgaacttcaaagaagagaacaacaatggctctcagaagatttctggtgatgctctaaaggacctgtacaagtcctttgtcgctgagtacccaatcgtgtccattgaggacccatttgaccaagatgactgggagcactatgctaagatgaccactgagtgtggaaccgaggttcagattgtcggtgatgatttgttggtcactaaccccaagagagttgctaaggcaatcgcagagaagtcttgcaatgctcttcttttgaaggttaaccaaatcggatctgtaaccgagagtatcgaggcagttaagatgtcgaagaaagcaggttggggagtgatgaccagccacagaagtggtgaaaccgaggacacattcattgctgacttagccgttggcttgtccactggacaaatcaaaaccggtgctccttgcagatccgagcgtcttgccaagtacaaccagcttttgcgtattgaggaggagttgggatcagaggcaatttacgctggagtcaacttccgcaaacctgtggaaccctactaa

SEQ ID NO: 224 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 225 - DNA, 1419 bp, Populus trichocarpa
atgacgattactattgtctccgtcaaggcaaggcagatcttcgacagccgtggcaatccaaccgtcgaggctgatgtgacaacatccgatggcgttttgtcaagagctgccgttcctagcggtgcatccactggcgtttacgaggcccttgaacttagggatggaggctcagattatcttggaaagggtgtttccaaggctgttgggaatgtcaatacaattattgggcctgcattgattggcaaggacccaactgagcaggtcgctattgataacttgatggttcaacaacttgatggaactgtaaatgagtggggctggtgcaaacaaaagcttggagcaaatgccatcttggcagtttctcttgctgtttgcaaagctggggcccatgccaagggtatacccctttataagcacattgccaaccttgctggtaacaagaacttggtgctgccagttcctgctttcaatgtcatcaacggtggatcacatgccggaaataaacttgctatgcaggcacgcattttgatatttcatctaatttacttttcaaggatgctgcttgaattcgagtttctgactttgtttcatctgcaggagttcatgattcttccaacgggagcttcctctttcaaagaggccatgaagatgggagctgaagtataccatcatttgaagtccgtgattaagaagaagtacggtcaggatgcaacaaatgttggtgatgaaggtggttttgctcccaacattcaggataaccaggaaggacttgaattgctcaagactgccattgctaaagctggttacacaggcaaagtggttattggaatggatgttgctgcctctgaattttatggagcagataaaacatatgaccttaacttcaaagaagagaacaatgatggttcaaaaaagatcacaggtgatgctctcaaggacctctacaagtctttcgtgtccgagtaccctattgtatcgattgaagatccatttgaccaagatgactgggaacactatgcaaagttaactgctgaaatcggagagaaagtacaaattgtgggagatgatctcttggtcaccaatcccaagagggttgagaaggctatcaaagagaaagcttgtaatgccctcctcctcaaggttaatcaaattggatctgttactgagagcattgaagctgtaaagatgtccaagcaagctggatggggagtgatggccagccaccgcagtggtgaaacagaggatactttcattgctgatttgtcagtgggtttggccacgggccaaataaagactggagcaccttgcaggtccgagcggcttgctaaatataaccagatcttgcgaattgaggaagagcttggcgcagaagcggtctatgccggagcaaacttcaggagacctgtcgaaccctattag

SEQ ID NO: 226 - protein, 472 aa, Populus trichocarpa
MTITIVSVKARQIFDSRGNPTVEADVTTSDGVLSRAAVPSGASTGVYEALELRDGGSDYLGKGVSKAVGNVNTIIGPALIGKDPTEQVAIDNLMVQQLDGTVNEWGWCKQKLGANAILAVSLAVCKAGAHAKGIPLYKHIANLAGNKNLVLPVPAFNVINGGSHAGNKLAMQARILIFHLIYFSRMLLEFEFLTLFHLQEFMILPTGASSFKEAMKMGAEVYHHLKSVIKKKYGQDATNVGDEGGFAPNIQDNQEGLELLKTAIAKAGYTGKVVIGMDVAASEFYGADKTYDLNFKEENNDGSKKITGDALKDLYKSFVSEYPIVSIEDPFDQDDWEHYAKLTAEIGEKVQIVGDDLLVTNPKRVEKAIKEKACNALLLKVNQIGSVTESIEAVKMSKQAGWGVMASHRSGETEDTFIADLSVGLATGQIKTGAPCRSERLAKYNQILRIEEELGAEAVYAGANFRRPVEPY

SEQ ID NO: 227 - DNA, 1599 bp, Populus trichocarpa
atgtcggtgcaggaatacctagacaagcacgtgctctctcgtaaaatcgaagacgccgtcaatgccgccgtcagggccaaaactcccgatcctgttctcttcatatcaaatcacatgagaaaagcggttccgtcagtgataacgaaaataaaagggaggcagatcctggatagcagaggaattcctactgttgaagttgacttgttcaccaacaaaggcagcttccgtgcttctgttcctagcggtcatgttactggcatgtatgaagctgtagaactgagagatggggacaaaggaatgtatctcggaaacagtgtgactagagctgttaagaacattaatgagaagatatctgaagcactgattggcatggacccgacacttcagtctcaaattgatcaggctatgatagacttggacaaaacagaaaagaagggtgaacttggagcaaatgctatgttagctgtgtcaattgctgcatgcaaagctggagccgctgaaaaggaggcatgagttccactttacaaacacatttctgatctttccagcaaaaccaacccgactcttcctgtcccagccttcactgtcataagtggtggaaaacatgctgggaacaatctagccattaaggaaatcatgattcttccaattggagccagcacatttgaggaggcactacaaatgggttccgaaacataccatcatctaaaggctgttataaaagaaaaatatggtgaacaaggatgcaatgttggtgaagatggtggtttttctccaaacttatccaggcaagatagttacaatctgctgtctgcccccctaaaagagagcaatatatgttcaaaactcatatggggttcttatttgattatatccattggcagtgttcaagaaggattgaatcttgttaaagaggctatcagcagaacagggtacagtgagaaaattaagatggccattgatgtcgctgcaaccaccttttgcataggtaccaagtatgatttggactacaaattccaaaataaatctgggcagaatttcaagtcaggagatgatatgattaagatgtacgaagaactatgtgctgcgtacccgattgtttcgattgaagatccatttgatagggaggattgggaacatgtcaagcgtttctctgaccttggactttgtcaggtatgttcattacatttgggtttatcttttgtttacatacatacgaggagctgtaaaaggatttgttctcaggttgtaggggatgacttattgatgtcaaatcacaaacgtattgaaagagcaatacatgagtccagttgcactgcacttcttctcaaggtaaatcagattgggacagtaacagaagcccttgaagtggtgaagctggcaaaggatgcccactggggtgtggtggtatctcatagaagtggagaaacagaagattcttttatagctgatttatctgttggccttgccatgggtcagatcaaaacaggcgctccttgcaggggagagcgactagcaaaatacaaccagttgcttcggattgaggaagaactgggtgatcaagcagtttatgcaggtgaagattggagagcaacctga

SEQ ID NO: 228 - protein, 531 aa, Populus trichocarpa
MSVQEYLDKHVLSRKIEDAVNAAVRAKTPDPVLFISNHMRKAVPSVITKIKGRQILDSRGIPTVEVDLFTNKGSFRASVPSGHVTGMYEAVELRDGDKGMYLGNSVTRAVKNINEKISEALIGMDPTLQSQIDQAMIDLDKTEKKGELGANAMLAVSIAACKAGAAEKEAVPLYKHISDLSSKTNPTLPVPAFTVISGGKHAGNNLAIKEIMILPIGASTFEEALQMGSETYHHLKAVIKEKYGEQGCNVGEDGGFSPNLSRQDSYNLLSAPLKESNICSKLIWGSYLIISIGSVQEGLNLVKEAISRTGYSEKIKMAIDVAATTFCIGTKYDLDYKFQNKSGQNFKSGDDMIKMYEELCAAYPIVSIEDPFDREDWEHVKRFSDLGLCQVCSLHLGLSFVYIHTRSCKRICSQVVGDDLLMSNHKRIERAIHESSCTALLLKVNQIGTVTEALEVVKLAKDAHWGVVVSHRSGETEDSFIADLSVGLAMGQIKTGAPCRGERLAKYNQLLRIEEELGDQAVYAGEDWRAT

SEQ ID NO: 229 - DNA, 1485 bp, Populus trichocarpa
atggccttggctacacaaccagccaccaacttcttcaacaaaaagaaccctttactcaatagcttctctacaaaacaacccaaaacatcaacacggtctttagttatcagaaactccgtgactgtggctccaccatcaacggtcaggattgctaaagaatgcaaggtgaagtcagtgaaggcgaggcagatcattgatagcagagggaatcctaccgttgaggttgatctcgtcactgatgatcagctttaccgatcggctgtaccaagtggggcttctactgggatctatgaggctttggaacttagagatggagataaaagtgtttatggtggcaagggtgtgcttagtgctgttcaaaatgttaataactttttgggtcctaagcttcttggtgttgatgtcagaaatcaagctgatgtggatgctataatgctggatattgatggaactccaaataaggcaaaattgggtgctaatgctattcttggagtatccctgagtgtgtgccgggctggtgcaggggccaagggagttccattgtataaacacatccaggaaatatcaggaaccaaggagcttgttatgcctgttccagcttttaatgtcattaatggaggcagtcatgctggaaataatctggccatgcaagaatttatgattctgcctgtaggtgcgaccaatttcgctgaagcactccgaatgggcagcgaagtgtatcatacactgaagaaaattattgagaaaaaatatggacaagatgcttgcaatgttggagacgaggggggatttgctcccaatgttcaggataacagggaaggactagttttgctcatggatgcgattgaaaaggctggatacacaggaaagatcaagataggaatggacgttgctgcttcagagtttctcaaagatggaaaatatgatttgaactttaaaaaccaaccaaatgatggagctcatgtgctctcagcccaaagccttggtgacctctacaaggattttgtcaaggaattccctattgtgtctattgaagatccctttgaccaggatgattggaattcatgggcttcactacaatcttcagttgatatccagattgttggagatgatttgttggtcacaaatccaaagagaatcgctgaggcaattcagaaaaaggcttgcaatggcttgctactgaaggcgagcatcaaatctatcataaaatggaatttgcaagttaaccagataggtacagtgactgaatccattagagcagcacttgactccaaagctgcaggttggggtgtgatggtcagccatcgtagtggtgaaactgaggataacttcatagctgatctttctgttggcttggccagtggacagatcaagactggagctccttgcagaagtgagcggttggccaagtataatcagcttctgcgcattgaagaggaacttggaaatgtgcgatatgctggtgaagctttcagatccctttaa

SEQ ID NO: 230 - protein, 494 aa, Populus trichocarpa
MALATQPATNFFNKKNPLLNSFSTKQPKTSTRSLVIRNSVTVAPPSTVRIAKECKVKSVKARQIIDSRGNPTVEVDLVTDDQLYRSAVPSGASTGIYEALELRDGDKSVYGGKGVLSAVQNVNNFLGPKLLGVDVRNQADVDAIMLDIDGTPNKAKLGANAILGVSLSVCRAGAGAKGVPLYKHIQEISGTKELVMPVPAFNVINGGSHAGNNLAMQEFMILPVGATNFAEALRMGSEVYHTLKKIIEKKYGQDACNVGDEGGFAPNVQDNREGLVLLMDAIEKAGYTGKIKIGMDVAASEFLKDGKYDLNFKNQPNDGAHVLSAQSLGDLYKDFVKEFPIVSIEDPFDQDDWNSWASLQSSVDIQIVGDDLLVTNPKRIAEAIQKKACNGLLLKASIKSIIKWNLQVNQIGTVTESIRAALDSKAAGWGVMVSHRSGETEDNFIADLSVGLASGQIKTGAPCRSERLAKYNQLLRIEEELGNVRYAGEAFRSL

SEQ ID NO: 231 - DNA, 1338 bp, Populus trichocarpa
atggtaacgatcaaggctgttaaagctcgtcaaatttttgacagtcgtggaaatcccaccgttgaagctgatattttgctctctgatggaagctatgctagagctgccgttccaagtggtgcttccactggtgtctatgaagctttagagttgagagatggaggatcagattatcttgggaaaggtgtacttaaggctgtagggaatgtcaattctatcattggaccagccttgattggcaaggacccaacagagcaggttcaaatcgataatttcatggtacaagagctggatggaactgttaatgaatggggttggtgcaagcagaagctcggagcaaatgctatattggcagtgtcacttgctgtttgcaaagcaggtgcaatggttaagaagatccctctttaccagcacattgcaaatcttgctggaaacaagaccttggttttgccagtacctgcattcaatgtcatcaatggaggttcccatgctggaaataaactggcaatgcaggaattcatgattctccctgttggggcatcatctttcaaggaagccatgaaaatgggtgtagaagtgtatcatcacctgaagtctgtgattaagaagaagtatggacaagatgccaccaatgttggtgatgaaggtggctttgctcctaatattcaggaaaacaaagagggtcttgaactgctcaagacagcgatagccaaagctggatatactggaaaggttgtgattgggatggatgttgctgcgtcagagttttataatgacaaggacaagacctatgatttgaatttcaaggaagagaacaatgatggatcacagaagatatctggagacagtctaaagaatgtatacaagtcatttgtggctgattatccaattgtgtccatcgaggatccatttgatcaagatgattgggaacactatgctaagatgactggtgaagttggtgaacaggtgcaaattgttggtgatgatctacttgtcacaaaccccaagcgtgtggagaaagcaattaaggagaagtcctgcaatgcccttctattgaaggtgaatcaaattggttctgtaactgaaagtattgaagctgtgaaaatgtctaaacatgctggctggggtgtcatggcaagccacagaagtggtgaaactgaggatactttcattgcagacctttcagttggattgtctactggacagatcaagactggagctccttgcagatcagaacgccttgcaaaatacaaccagcttctcaggatagaggaagagctgggatctgcagcagtatatgcaggagcaaaattcagggcaccagttgaaccttactaa

SEQ ID NO: 232 - protein, 445 aa, Populus trichocarpa
MVTIKAVKARQIFDSRGNPTVEADILLSDGSYARAAVPSGASTGVYEALELRDGGSDYLGKGVLKAVGNVNSIIGPALIGKDPTEQVQIDNFMVQELDGTVNEWGWCKQKLGANAILAVSLAVCKAGAMVKKIPLYQHIANLAGNKTLVLPVPAFNVINGGSHAGNKLAMQEFMILPVGASSFKEAMKMGVEVYHHLKSVIKKKYGQDATNVGDEGGFAPNIQENKEGLELLKTAIAKAGYTGKVVIGMDVAASEFYNDKDKTYDLNFKEENNDGSQKISGDSLKNVYKSFVADYPIVSIEDPFDQDDWEHYAKMTGEVGEQVQIVGDDLLVTNPKRVEKAIKEKSCNALLLKVNQIGSVTESIEAVKMSKHAGWGVMASHRSGETEDTFIADLSVGLSTGQIKTGAPCRSERLAKYNQLLRIEEELGSAAVYAGAKFRAPVEPY

SEQ ID NO: 233 - DNA, 1464 bp, Ostreococcus tauri
atgagcgtccaggagtacatcgaaaagcacgacctcacgcgtaaggttgaggaggcgctgaacgccgcggtgaaggccaaggcggatgaaccgctcgcgttcgtgagcgagtacatgaagaagcgcaccgcgccggccatcacgaaggtcgtcggtcgccaaatcttcgactcccgcggtaacccgacggtcgaggccgacgtgtacacgcacaagggtatgttccgcgccatggtgccgagcggcgcttccaccggtatctacgaagcggtggagcttcgcgacggtggcaacacgtacatgggcaagggcgtgcagcaagccgtcaagaacttgaacgaaatcatcgccccggcgctcgttggcaaggacccgcgcgagcaaaaggcacttgatgacttcatgtgcaaggaactcgacggcacggagaacaagggcaagctcggcgcgaacgccatcctcgccgtctccatggctatcgccaaggcgggcgccgccgaaaaggacgtgccgctctacaagcacctcgccgacctcgcgggcaacggtaagttggtcctcccggtcccggcgttcaacgtcattaacggtggctcccacgccggtaacaaactcgccatgcaagagtttatgattttgcccgtcggcgccaagaccttcaaggaagccatgcaaatgggctccgaagtgtaccacaacttgaagtctgtcatcaagaagaagtacggccaagacgcgtgcaacgtcggtgacgaaggtggcttcgccccgaacattcaagacaacaaggaaggtctcgacctcctcgttgaagcgatcgaaaaggctggctacaccggcaagatgaagatcggtatggacgtcgccgcctccgagttcctgaccgaagacaagcaatacgaccttgacttcaagactgagaacaacgacggttccatgaagaagacgggcgctcaaatgatcgacttgtaccaagagttcatcaacgagtatccgatgatctccatcgaggatccgttcgaccaagacgacgctgaaaacaccgcggcgctcaccgccaagggcaactgccaaatcgtcggtgacgacttgttggtgaccaacccgaagcgcgtgcaagccgccatcgacggtaagtggtgcaacgccctcttgctcaaggtgaaccaaatcggtaccatctccgagtccatcgaagccgtcggcatgtccaagcgcgccggttggggtgtgatggcctcccaccgatccggcgagaccgaagattgctttatcgctgatcttgcggtcggcttatccactggccaaatcaagaccggcgctccgtgccgctccgagcgcttggcaaagtacaaccagctcctccgcatcgaagaggaactcggcgacgccgccgtgtacgcgggcgaaaactacaagcacattgcttggtagagcgcctctcgcttccgtagatccccatga

SEQ ID NO: 234 - protein, 486 aa, Ostreococcus tauri
MSVQEYIEKHDLTRKVEEALNAAVKAKADEPLAFVSEYMKKRTAPAITKVVGRQIFDSRGNPTVEADVYTHKGMFRAMVPSGASTGIYEAVELRDGGNTYMGKGVQQAVKNLNEIIAPALVGKDPREQKALDDFMCKELDGTENKGKLGANAILAVSMAIAKAGAAEKDVPLYKHLADLAGNGKLVLPVPAFNVINGGSHAGNKLAMQEFMILPVGAKTFKEAMQMGSEVYHNLKSVIKKKYGQDACNVGDEGGFAPNIQDNKEGLDLLVEAIEKAGYTGKMKIGMDVAASEFLTEDKQYDLDFKTENNDGSMKKTGAQMIDLYQEFINEYPMISIEDPFDQDDAENTAALTAKGNCQIVGDDLLVTNPKRVQAAIDGKWCNALLLKVNQIGTISESIEAVGMSKRAGWGVMASHRSGETEDCFIADLAVGLSTGQIKTGAPCRSERLAKYNQLLRIEEELGDAAVYAGENYKHIAWSASRFRRSP

SEQ ID NO: 235 - protein, 137 aa, Artificial sequence
  PFOO113 enolase_N domain in SEQ ID NO: 194
TIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHI

SEQ ID NO: 236 - protein, 296 aa, Artificial sequence
  PFO3950 enolase_N domain in SEQ ID NO: 194
QLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPV

SEQ ID NO: 237 - protein, 7 aa, Artificial sequence
  Motif 12
  VARIANT (4)..(4): /replace = "Gln"
SIEDPFD

SEQ ID NO: 238 - protein, 6 aa, Artificial sequence
  Motif 13
VGDDLL

SEQ ID NO: 239 - protein, 5 aa, Artificial sequence
  Motif 14
GAPCR

SEQ ID NO: 240 - protein, 9 aa, Artificial sequence
  Motif 15
  VARIANT (5)..(5): /replace = "Ile"
KYNQLLRIE

SEQ ID NO: 241 - DNA, 2194 bp, Oryza sativa; identical to SEQ ID NO: 188

SEQ ID NO: 242 - DNA, 1827 bp, Oryza sativa
gcttgagtcatagggagaaaacaaatcgatcatatttgactcttttccctccatctctcttaccggcaaaaaaagtagtactggtttatatgtaaagtaagattctttaattatgtgagatccggcttaatgcttttcttttgtcacatatactgcattgcaacaattgccatatattcacttctgccatcccattatatagcaactcaagaatggattgatatatcccctattactaatctagacatgttaaggctgagttgggcagtccatcttcccaacccaccaccttcgtttttcgcgcacatacttttcaaactactaaatggtgtgttttttaaaaatattttcaatacaaaagttgctttaaaaaattatattgatccatttttttaaaaaaaatagctaatacttaattaatcacgtgttaaaagaccgctccgttttgcgtgcaggagggataggttcacatcctgcattaccgaacacagcctaaatcttgttgtctagattcgtagtactggatatattaaatcatgttctaagttactatatactgagatgaatagaataagtaaaattagacccaccttaagtcttgatgaagttactactagctgcgtttgggaggacttcccaaaaaaaaaagtattagccattagcacgtgattaattaagtactagtttaaaaaacttaaaaaataaattaatatgattctcttaagtaactctcctatagaaaacttttacaaaattacaccgtttaatagtttggaaaatatgtcagtaaaaaataagagagtagaagttatgaaagttagaaaaagaattgttttagtagtatacagttataaactattccctctgttctaaaacataagggattatggatggattcgacatgtaccagtaccatgaatcgaatccagacaagttttttatgcatatttattctactataatatatcacatctgctctaaatatcttatatttcgaggtggagactgtcgctatgtttttctgcccgttgctaagcacacgccacccccgatgcggggacgcctctggccttcttgccacgataattgaatggaacttccacattcagattcgataggtgaccgtcgactccaagtgctttgcacaaaacaactccggcctcccggccaccagtcacacgactcacggcactaccacccctgactccctgaggcggacctgccactgttctgcatgcgaagctatctaaaattctgaagcaaagaaagcacagcacatgctccgggacacgcgccacccggcggaaaagggctcggtgtggcgatctcacagccgcatatcgcatttcacaagccgcccatctccaccggcttcacgaggctcatcgcggcacgaccgcgcacggaacgcacgcggccgacccgcgcgcctcgatgcgcgagcccatccgccgcgtcctccctttgcctttgccgctatcctctcggtcgtatcccgtttctctgtcttttgctccccggcgcgcgccagttcggagtaccagcgaaacccggacacctggtacacctccgccggccacaacgcgtgtccccctacgtggccgcgcagcacatgcccatgcgcgacacgtgcacctcctcatccaaactctcaagtctcaacggtcctataaatgcacggatagcctcaagctgctcgtcacaaggcaagaggcaagaggcaagagcatccgtattaaccagccttttgagacttgagagtgtgtgtgactcgatccagcgtagtttcagttcgtgtgttggtgagtgattccagccaagtttgcg

SEQ ID NO: 243 - DNA, 49 bp, Artificial sequence
  primer 9
ggggacaagtttgtacaaaaaagcaggcttaaacaatggcggcgacgat

SEQ ID NO: 244 - DNA, 47 bp, Artificial sequence
  primer 10
ggggaccactttgtacaagaaagctgggttttagtagggctccacgg

SEQ ID NO: 245 - protein, 186 aa, Artificial sequence
  DNA binding domain
SKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGM

SEQ ID NO: 246 - protein, 152 aa, Artificial sequence
  repressor domain
EYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 247 - DNA, 1490 bp, Arabidopsis thaliana
aaaaagggttaggtggatctctcatgaaatcggtggagctcccccatatcttttttaaatagctttcttcttttggccccttacccagagatagattcttatatactactgagaatcttcaatttctgcaacttttgtatctcttcctgatcaccaaataagaaaactcttgtggttctattgaattgggtttccactatctttattgtagagatggagtcttcaagtccccaccatagtcacattgttgaggttaatgttggaaaatctgatgaagagagaataattgtggcgagtaaagtctgtggagaagcaccatgtgggttttcagattctaagaatgcttccggggatgctcacgaacgctctgcttctatgcggaagctttgtatcgccgtcgtgctgtgtctagtgttcatgagtgttgaagttgttggtgggattaaagccaatagtttagctatattaaccgatgcagctcatttgctctctgacgttgctgcctttgctatctccctcttctcattgtgggctgctggctgggaagcgactcctaggcagacttacgggttcttcaggattgagattttgggtgctcttgtatctatccagctcatttggttgctcacgggtattctggtttatgaagcgattatcagaattgttacagagaccagtgaggttaatggattcctcatgtttctggttgctgcctttggtctagtggtgaacatcataatggctgttctgctagggcatgatcatggtcacagtcatggacatgggcatggccacggccatgaccatcacaatcatagccatggggtgactgttaccactcatcaccatcatcacgatcatgaacatggccatagtcatggtcatggagaggacaagcatcatgctcatggggatgttactgagcaattgttggacaaatcgaagactcaagtcgcagcaaaagagaaaagaaagagaaacatcaatctccaaggagcttatctgcatgtccttggggattccatccagagtgttggtgttatgattggaggagctatcatttggtacaatccggaatggaagatagtggatctgatctgcacacttgccttttcggttattgtcctaggaacaaccatcaacatgattcgcaacattctagaagtattgatggagagtacacccagagagattgacgccacaaagctcgaaaagggtttgctcgaaatggaagaagtggtggctgttcatgagctccacatatgggctatcacagtgggaaaagtgctattggcttgccatgtcaatatcagaccagaagcagatgcagatatggtgctcaacaaggtaattgattacatccgcagggagtacaacattagtcatgtcacgatacaaatcgagcgctaaaagctaagtaagatctgatgaagggtttttgtatcagcattctcattaacaataaaatcaataaagtttctactcgtgcc

SEQ ID NO: 248 - DNA, 1197 bp, Arabidopsis thaliana
atggagtcttcaagtccccaccatagtcacattgttgaggttaatgttggaaaatctgatgaagagagaataattgtggcgagtaaagtctgtggagaagcaccatgtgggttttcagattctaagaatgcttccggggatgctcacgaacgctctgcttctatgcggaagctttgtatcgccgtcgtgctgtgtctagtgttcatgagtgttgaagttgttggtgggattaaagccaatagtttagctatattaaccgatgcagctcatttgctctctgacgttgctgcctttgctatctccctcttctcattgtgggctgctggctgggaagcgactcctaggcagacttacgggttcttcaggattgagattttgggtgctcttgtatctatccagctcatttggttgctcacgggtattctggtttatgaagcgattatcagaattgttacagagaccagtgaggttaatggattcctcatgtttctggttgctgcctttggtctagtggtgaacatcataatggctgttctgctagggcatgatcatggtcacagtcatggacatgggcatggccacggccatgaccatcacaatcatagccatggggtgactgttaccactcatcaccatcatcacgatcatgaacatggccatagtcatggtcatggagaggacaagcatcatgctcatggggatgttactgagcaattgttggacaaatcgaagactcaagtcgcagcaaaagagaaaagaaagagaaacatcaatctccaaggagcttatctgcatgtccttggggattccatccagagtgttggtgttatgattggaggagctatcatttggtacaatccggaatggaagatagtggatctgatctgcacacttgccttttcggttattgtcctaggaacaaccatcaacatgattcgcaacattctagaagtattgatggagagtacacccagagagattgacgccacaaagctcgaaaagggtttgctcgaaatggaagaagtggtggctgttcatgagctccacatatgggctatcacagtgggaaaagtgctattggcttgccatgtcaatatcagaccagaagcagatgcagatatggtgctcaacaaggtaattgattacatccgcagggagtacaacattagtcatgtcacgatacaaatcgagcgctaa

SEQ ID NO: 249 - protein, 398 aa, Arabidopsis thaliana
MESSSPHHSHIVEVNVGKSDEERIIVASKVCGEAPCGFSDSKNASGDAHERSASMRKLCIAVVLCLVFMSVEVVGGIKANSLAILTDAAHLLSDVAAFAISLFSLWAAGWEATPRQTYGFFRIEILGALVSIQLIWLLTGILVYEAIIRIVTETSEVNGFLMFLVAAFGLVVNIIMAVLLGHDHGHSHGHGHGHGHDHHNHSHGVTVTTHHHHHDHEHGHSHGHGEDKHHAHGDVTEQLLDKSKTQVAAKEKRKRNINLQGAYLHVLGDSIQSVGVMIGGAIIWYNPEWKIVDLICTLAFSVIVLGTTINMIRNILEVLMESTPREIDATKLEKGLLEMEEVVAVHELHIWAITVGKVLLACHVNIRPEADADMVLNKVIDYIRREYNISHVTIQIER

SEQ ID NO: 250 - DNA, 1926 bp, Arabidopsis thaliana
gtgggataataacctactctaaagcaagatagccaaagctagaaatcctcttgttaagacatcttatgatatacaaatctttgtttctactttcttcattcattctgcaggtagcgaaaggatttggtagttaaataagtggctggtcaacgaaaaatcaaaagcataatgctttcaagaaccaaggtatgtcttcttttatctgttattaaaatttctgataccgctttgtatatgtgctttgataggactacatgttttatgtgccctgataatcttcggaaattgaaaaagtcaaaccaaaaaaaatgatttgcagatcggctaatgaagaacagttcaattaaaagtctaatagatagtcttaaaataaagaaaggtttgatagtcaatagtcatttcgtgtctcagatggattaccaatgtaatatataatatatgatactatatagttttgagaaagagactagatgggaggcatgtatcatgactttctctatttctttttgttctctctcagttttccaatattgcgtataacttttggttttgaggttttatatataaagagtttgccagaatggtatggtgacacccaaattacatctcgatctctctcttacaaaaaagatgaaagaccatattcatgagcatgaccacatggttcagatttgtggggaagtttcatcaggagaaacaagcttggtgggcatcaagaagacatgtggagaagcgccttgcggattctcagatgccaagaccagttcaatagaagctcaagagcgtgcagcatcaatgagaaagctattaatagctgttcttctctgtgccattttcatagttgtagaagtcgttggaggaatcaaggccaacagtcttgcgattctcacagatgcagctcatctgttatctgatgttgcagcctttgcaatatctttgttctcgctctgggcttcgggatggaaggcaaaccctcagcaatcttatgggtttttcagaatagagattcttggtgctcttgtctccattcaaatgatttggcttcttgctggtatcttggtttatgaagccattgttagacttaacaacggtagtggtgaagtggagggatctcttatgtttgctgtctctgcagttggcttacttgtgaacattgcaatggctattctgttaggtcatgaccatggtcatggtcatggtcatagtcatgacaatggtcacggtcatagtcatgatcatggccatggaatagccgcaaccgagcatcatcatgactctggtcatgatgaatcacaactatctgatgtcttaatcgagcaaaagaagcagcgtaatgtaaatattcaaggggcttatcttcacgtgctgggagattcgatacagagcgtaggagtgatgataggaggagcaatcatatggtataagccggagtggaagatccttgatttgatatgcacattggttttctctgtgattgtgttagggacaacaattgggatgcttaggaacattctagaggttttaatggagtcaacaccacgagagattgacccgacaatgcttgaaaagggagtgtgtgaaattgaagaagtggtggctgttcatgagcttcacatttgggcgattactgtcggcaaacttttgttggcatgtcatgttaaaatcagacctgaggcagaggcagatatggttttggacaagattatcgattacattaagagggaacacaacattagtcacgtgactattcagatcgaacgtcaatgaagcaacgtgacaaggcgtttttgcattatcatatctactttgtctgaccattttgtaatgtttgtcttgtgtacaaaagtgtttttttttcccaacgtatgtatcatattgtctataattgttttttggtttgaggataagccctgcgttaacgatcaa

SEQ ID NO: 251 - protein, 393 aa, Arabidopsis thaliana
MVTPKLHLDLSLTKKMKDHIHEHDHMVQICGEVSSGETSLVGIKKTCGEAPCGFSDAKTSSIEAQERAASMRKLLIAVLLCAIFIVVEVVGGIKANSLAILTDAAHLLSDVAAFAISLFSLWASGWKANPQQSYGFFRIEILGALVSIQMIWLLAGILVYEAIVRLNNGSGEVEGSLMFAVSAVGLLVNIAMAILLGHDHGHGHGHSHDNGHGHSHDHGHGIAATEHHHDSGHDESQLSDVLIEQKKQRNVNIQGAYLHVLGDSIQSVGVMIGGAIIWYKPEWKILDLICTLVFSVIVLGTTIGMLRNILEVLMESTPREIDPTMLEKGVCEIEEVVAVHELHIWAITVGKLLLACHVKIRPEAEADMVLDKIIDYIKREHNISHVTIQIERQ

SEQ ID NO: 252 - DNA, 1313 bp, Arabidopsis thaliana
gtttgactctctgttatggtatgagtatgttgtcatatcatttaatgtgaatttttggtttgctcgcatccttgtgtagttgtgggatgcatgtctctgttttttccacctttaaaaatctccttcaagtctcaaactctaacaccttactcctgaattgagtttctactatcttgttgtaagatggattcaagaagaagtaaagtttgtggagaaacagcttgtgggttttcaacatcttcaagtgatgctaagaaacgagctgcttcaatgcgaaagctctgtttcgttgtggtgttatgtcttttgttcatgagcatagaagttgtttgtggcattaaggctaacagtttggctatattagcagatgcagctcatttgctcactgatgttggtgcttttgctatctctatgctctccttgtgggcttcttcttgggaagcaaatccgcgacagagttatgggttcttcaggatagagattttaggcactcttgtctcaatccagctcatttggttactcactgggattttggtctacgaagccgtaactagactcgttcaagagaccaatgatgatgttgatggtttctttatggttcttgttgctgcttttggtttagttgtaaacatcataatgattgttgtgcttggacatgatcacggacatgggcatgatcatggtcacagtcatgatcatggtcatagttatggggaaagagctgagcagttgttggagaaatccaaggaaataaggaacattaatgtgcaaggggcttatcttcatgttcttggggatttaattcagagcattggggtaatgattggagggggtatgatttggtataaccctaaatggaaagtaattgacttgatatgcacgttattcttttcagttattgttttagggacaaccattaagatgcttcgaagcatacttgaagttctaatggagagcacaccgagagagatagacgcgaggcagctcgaaaagggattgatggaaattgaggaagttgtggatgttcatgagctgcacatatgggcaattacagttggaaaagctctgttttcttgtcatgtcaaggttagaccagaagctggtgatgaaatggtgctgaacaaagtgatcgattacatctggagagagtatcgtatcagtcacgttacgatacaaatcgagcgttaaaacaacaaaagggttcatttctctggttttctgtcattttcatgatcaaagttaaatcttttttcgctttctcgtatgctctcattaccttgttgtgacatatgccattgtctttcttgtttatg

SEQ ID NO: 253 - protein, 334 aa, Arabidopsis thaliana
MDSRRSKVCGETACGFSTSSSDAKKRAASMRKLCFVVVLCLLFMSIEVVCGIKANSLAILADAAHLLTDVGAFAISMLSLWASSWEANPRQSYGFFRIEILGTLVSIQLIWLLTGILVYEAVTRLVQETNDDVDGFFMVLVAAFGLVVNIIMIVVLGHDHGHGHDHGHSHDHGHSYGERAEQLLEKSKEIRNINVQGAYLHVLGDLIQSIGVMIGGGMIWYNPKWKVIDLICTLFFSVIVLGTTIKMLRSILEVLMESTPREIDARQLEKGLMEIEEVVDVHELHIWAITVGKALFSCHVKVRPEAGDEMVLNKVIDYIWREYRISHVTIQIER

SEQ ID NO: 254 - DNA, 1477 bp, Cathamus tinctorius
atatatattacccgaattgtccttggtctcttaaccaaacatcatgatcggaatccccaatatcttcttcacagacgccattattctcttctatataaatccatctatatacctccatggataaaccctactccacctccacctccacctccacctccaaagtgtaggcctctacaaacccttattgcctcctccttctgatccatcgctcaataatcaaaccgcttgatctctcagatggatgctgagaaccgaggccatgggcatgccgttgacatatctgcggatgcgccagctgaagagaacaggctaaccggaagtaaagtttgtgggggagcgccgtgtgggttctcggatgcgaaagcgagttctaaggaggcaagggagcggtcggcttccatgtggaagctttggggtggggttatattgtgcttcattttcatgggtgttgaagtatttggtggaattaaagcaaacagtcttgcaatattgaccgatgccgctcatttgttatccgacgttgctgcttttgcgatttcgttgttttcggtttgggcttctgggtgggaagccacacctcgtcagtcttatgggtttttcaggatcgagattcttggaacgctggtgtccattcagatcatatggctgcttactgggattctggtatacgaagcaatagttaggctcattcatggtacaattgaagtcgaaggcagacttatgttcataattgctgcttttggcttaattgttaacatagtcatgatattcatactcggtcatgaccatggccatggccatggccatagtcacggccatggacatggacatggacatcaagagcatgatcatggtgatagccaagaagatgtgcatatccatggagttagcgtcacaacacatcatcaccaccatcatggtcctggtcatgatcatggtcatgatcatggtcatggtcatgacgaacaacaactgcagcagccgctactgaagacgtactctggaggtgaagtgaaagagaagaagaggaatataaacgttcaaagtgcttatcttcacgttttgggggattcgattcagagcatcggcgtaatgattggggcgggggtaatttggtacaaaccggagctgaaaatcatcgaccccatttgcgcgttgctgttttcgatcatagttttgtatacgaccatcaacatgctgcgtgacatattggaggttctgatggaaagcacgccgagagagatcgatgcaacgagcctcgaaagggggctttgcgagatcaatgaggtggtcgccattcatgggctgcatatatgggcgattacggtcgggaaagtgctgttggcgtgccacgtgaggatcagacgcgaagccgatgcggatatggtgctggacaaggtggtggattacatcaagagggagtataacatcagccatgtaacaattcagatagagagagaataaatgaagtttgatt

SEQ ID NO: 255 - protein, 408 aa, Cathamus tinctorius
MDAENRGHGHAVDISADAPAEENRLTGSKVCGGAPCGFSDAKASSKEARERSASMWKLWGGVILCFIFMGVEVFGGIKANSLAILTDAAHLLSDVAAFAISLFSVWASGWEATPRQSYGFFRIEILGTLVSIQIIWLLTGILVYEAIVRLIHGTIEVEGRLMFIIAAFGLIVNIVMIFILGHDHGHGHGHSHGHGHGHGHQEHDHGDSQEDVHIHGVSVTTHHHHHHGPGHDHGHDHGHGHDEQQLQQPLLKTYSGGEVKEKKRNINVQSAYLHVLGDSIQSIGVMIGAGVIWYKPELKIIDPICALLFSIIVLYTTINMLRDILEVLMESTPREIDATSLERGLCEINEVVAIHGLHIWAITVGKVLLACHVRIRREADADMVLDKVVDYIKREYNISHVTIQIERE

SEQ ID NO: 256 - DNA, 1635 bp, Eucalyptus grandis
ggaagacgagggagacctagtcggagcgcaaacgcctccgccccgaaaagcaccagcggccgcgtcgatctctccatctccggagctcagtccggagcggcaagatgagcacgcatgattctgaacatgggcacatcattgaagtgtgtcaagatgtgccagccatggaaacaggccaggttggtagtaaggtatgcgcagaggcaccttgtggtttttcagacgttagaaatagtttgaaagatgcaagagagaggtcaacctctacgaagaaacttttaattgcggtggtgctttgtattatcttcatgagcatagaagtatttggtggtattgaagccaacagtcttgccattctcacagatgcagcgcatttgctgtcagatgttgccgcatatgcgatatccttattctctctttgggcatcaggttgggaggcaactccacgccagtcttatggtttcttccgaattgaaattcttggtgcacttgtctccatccagattatatggctacttgctgggattcttgtgtatgaagcaatagaaagacttatcaatggtacaacggaagttcatggctttctcatgttcattattgctgcctttggtcttcttgtgaatattgccatggcactgttactgggtcacgatcacagccatggacatggtcatgaccatgggcatggacatagtcatgggcatgatgatgcacatgaacatagtgatcatgctcatagccatgaggatcatggtgatttgcatactcatggattaaccatcaagaaacatgaccatcatcatcatggagaagattctaaaggacatgctgatcaacttcatggccatgaaacagatcaaactgagcctcttttgcagacttgctcggaagctgaaggtgactcaaaacttggagccaaacagaagcagcaacgtaatattaacatgcaaggtgcttatcttcatgtacttggggattccattcaaagtgtgggtgtgatgattggcggtgcaattatatggattaagcccgagtggacgattgtcgacttgatttgcaccctgatattctcagtaattgtgcttgggacaacaataaggatgctccgtaacattctggaggttttgatggagagtacgcctagagagattgatgccactaggctcgagagtggactttgcaagatggatgaagtgattgcagttcatgaactgcacatctgggctataacggttggaaaggtgctattagcctgccatgtcaaaataaagcgtgacgccaatgccgatatggtcctggacaaggtcgtggattacatcagaagagagtacaagataagtcacgtcaccattcaagtagaaagagagtagatgttggaaggtgaatgatttagttttggcattgtatatggatggtagcgttggggtcacaattcagcttctaatttgtttggatgttgccgtttcggcctttttctggtagctgggcctttgaggcccttcaggagtatgatgtaatgtccttactttctgtctaagtttctttcaccatgtttactagttcagtaagtattaaagagagctgctccaatttagctgaattggatctttaacaatgattactagttcaaaaaaa

SEQ ID NO: 257 - protein, 421 aa, Eucalyptus grandis
MSTHDSEHGHIIEVCQDVPAMETGQVGSKVCAEAPCGFSDVRNSLKDARERSTSTKKLLIAVVLCIIFMSIEVFGGIEANSLAILTDAAHLLSDVAAYAISLFSLWASGWEATPRQSYGFFRIEILGALVSIQIIWLLAGILVYEAIERLINGTTEVHGFLMFIIAAFGLLVNIAMALLLGHDHSHGHGHDHGHGHSHGHDDAHEHSDHAHSHEDHGDLHTHGLTIKKHDHHHHGEDSKGHADQLHGHETDQTEPLLQTCSEAEGDSKLGAKQKQQRNINMQGAYLHVLGDSIQSVGVMIGGAIIWIKPEWTIVDLICTLIFSVIVLGTTIRMLRNILEVLMESTPREIDATRLESGLCKMDEVIAVHELHIWAITVGKVLLACHVKIKRDANADMVLDKVVDYIRREYKISHVTIQVERE

SEQ ID NO: 258 - DNA, 1394 bp, Ipomoea nil
gggcaaaagtggaatctctttcctgggcggttgaaaatctctattcaagggccgctaactgttccaatcagagatggatgtacggatctcagagcatgaccaagtaattcaggtaagcggtgatgtcccagcacaggagaggggtgctgttgggagtaaattgtgtggggaagcaccatgtgggtttgcagatgctaaaaccagtttgaaggacacacaagagcgctcggcagccatgaaaaaactctgtattgctgtggtactctgtgtcgtgtttatgactgttgaagttattggaggtattaaagcaaacagtcttgcgatattgacggatgcggctcatttgttgtcagatgttgcagcttttgcaatatcgttgttttcactgtgggcggcaggatgggaagctaccccgcgccagtcctatgggtttttcaggattgagattcttggggcgttggtttctattcaaatgatatggcttcttgctgggatccttgtttatgaggctattgatagactgataaatgatacaggtgaagtccagggatccctcatgtttgcagtttctgcttttggattagtggtcaatataattatggctgtcttgcttggtcatgaccatggacatggacatggacatggacatggccatgaccatgggcacggagggcatgatcatgggcatggagggcatgatcatgggcatagccatgatggagttacaatcgttcaacaccatgaccatcacgaggggcattctggccacaacgaacacgagtcagatcatacacatcccctacttaaggcttgctccgagggtgaaaacggatcaaaaggtggaaagaagaaggaaaggaacataaatgtgcagggggcctatcttcacgtactcggggattctattcagagcgtgggcgtgatgattggcggggcaatcatatggtacaaaccagaatggaagatcatcgatctcttctgcactctaatcttctctgtgctcgtgctggtgacgaccataaggatgatacgcaatatcctcgaggtattgatggagagcaccccccgagagattgatgcaaccaggcttgagcaggggctttgtgagatggaggaggttgttgcagttcatgagttgcatatatgggcaataacagtggggaaagtgctgttagcctgccatgtaaagatcaagaaggaagcagatgccgacattgtactggacaaggtaattgactatattaaaacagagtacaatattacccatgttaccattcagatagaaagagagtagttagaacctgttggaacttggaagcctagaaatgtgtttgtaatccacatgatattgttttcagaatattttagactccggttggttcctcaatcaattt

SEQ ID NO: 259 - protein, 406 aa, Ipomoea nil
MDVRISEHDQVIQVSGDVPAQERGAVGSKLCGEAPCGFADAKTSLKDTQERSAAMKKLCIAVVLCVVFMTVEVIGGIKANSLAILTDAAHLLSDVAAFAISLFSLWAAGWEATPRQSYGFFRIEILGALVSIQMIWLLAGILVYEAIDRLINDTGEVQGSLMFAVSAFGLVVNIIMAVLLGHDHGHGHGHGHGHDHGHGGHDHGHGGHDHGHSHDGVTIVQHHDHHEGHSGHNEHESDHTHPLLKACSEGENGSKGGKKKERNINVQGAYLHVLGDSIQSVGVMIGGAIIWYKPEWKIIDLFCTLIFSVLVLVTTIRMIRNILEVLMESTPREIDATRLEQGLCEMEEVVAVHELHIWAITVGKVLLACHVKIKKEADADIVLDKVIDYIKTEYNITHVTIQIERE

SEQ ID NO: 260 - DNA, 1583 bp, Nicotiana benthamiana
gatcacaaatcacaaccctacactaatactgaatttttgaaaagtgggttgcatttttctattccgagattccttttatctcttcccttttttctcctttttcttctttctttaggtatataccccatatatagcctataaaccaaatagctatataaaaactctacatctatttggcgaatttgatgatttgggtaagctaaagatacgatcgttttactacccttttgaaatcttggcataaatttgtgagatggagacgcagaacctggaacgtggacatgtaattgaggtacgttgtgacatggcagctcaagaaaaggggactaaaatatgtggttcagcaccgtgtggattctcagatgttaacaccatgtctaaggatgcacaggagagatcggcatccatgaggaaactttgcatcgcggttgtcctctgcatcatttttatggctgtcgagtttgttggtggcattaaagccaacagtctggcaatattgacagacgctgctcatctactatcagatgttgcagcttttgcaatatcgttgttttcactttgggcagcaggatgggaagctaatccacgccagtcctatgggtttttcagaatcgagatactcggggcattagtttctatccaaatgatatggcttctagctgggatccttgtttatgaagccattgctcgtcttatacatgatacaggtgaagttcaaggcttcctcatgtttgtggtgtctgcatttggattagcagtgaacctcatcatggcactcttgctaggtcatgatcatggccacggccatggccacggccatggccacagccacggtcatgaacatggccatgaacacggccataatcatgaagaacatgctcatagccattctgatcatgagcacggccatggagagcatacacatatacatggaattagcgttagccgacaccatcaccataatgagggaccttcgagccgagatcaacactcccatgcacatgatgcagatcacaccgagcctctacttaaggattcatgtgagggtgaaggtgtgccagaaggtgaaaagaaaaagaagcagaggaacataaatgttcagggggcttatcttcatgtactaggagattctattcagagcataggggtcatgattggcggagctattatatggtataaaccagagtggaaaatcattgatctaatttgcactctcattttctctgtaattgtgctgggggcaaccattaagatgcttcgaagtattcttgaagtattaatggagagcacaccaagagaaattgatgcaacaaggctcgagaaggggctctgtgagatggaggacgttgtcacaatccacgaattgcacatatgggcgattacagtcggcaaagtgctcctggcttgccatgtcaagattaagcccgacgctgatgctgacacagtgctggataaggtgattgattatattaagagggaatataacattagccatgttaccattcaaatagaaagagagtaggggcatggaaaagtttattttggctgttgtactggtcattggcttctttattcttttgaat

SEQ ID NO: 261 - protein, 422 aa, Nicotiana benthamiana
METQNLERGHVIEVRCDMAAQEKGTKICGSAPCGFSDVNTMSKDAQERSASMRKLCIAVVLCIIFMAVEFVGGIKANSLAILTDAAHLLSDVAAFAISLFSLWAAGWEANPRQSYGFFRIEILGALVSIQMIWLLAGILVYEAIARLIHDTGEVQGFLMFVVSAFGLAVNLIMALLLGHDHGHGHGHGHGHSHGHEHGHEHGHNHEEHAHSHSDHEHGHGEHTHIHGISVSRHHHHNEGPSSRDQHSHAHDADHTEPLLKDSCEGEGVPEGEKKKKQRNINVQGAYLHVLGDSIQSIGVMIGGAIIWYKPEWKIIDLICTLIFSVIVLGATIKMLRSILEVLMESTPREIDATRLEKGLCEMEDVVTIHELHIWAITVGKVLLACHVKIKPDADADTVLDKVIDYIKREYNISHVTIQIERE

SEQ ID NO: 262 - DNA, 1513 bp, Nicotiana tabacum
atggagacgcagaacctggaacgtggacatgtaattgaggtacgttgtgacatggcagctcaagaaaaggggactaaaatctgtggttcagcaccgtgtggattctcagatgttaacaccatgtctaaggatgcacaggagagatcagcatccatgaggaaactttgcatcgcggttgtcctctgcatcatatttatggctgttgaggttgttggtggtattaaagccaacagtctggcaatattgaccgacgctgctcatctactatcagatgttgcagcttttgcaatatccttgttttcactctgggcagcaggatgggaagctaatccacgccagtcctatgggtttttcagaatcgagatactcggggcattagtttctatccaaatgatatggcttctagctgggatccttgtttatgaagccattgctcgacttattcatgatacaggtgaagttcaaggcttcctcatgtttgtggtgtctgcatttggattagtagtgaacctcatcatggcactcttgttaggtcatgatcatggccacggccacggccatggccacagccacggtcatgaccatgaacacggccataatcatggcgagcatgctcatagcaatactgatcatgagcacggccatggtgagcatacgcatatacatggaattagcgttagccgacaccatcaccataatgagggaccttcgagccgagatcaacacccccatgcgcatgatggagatcacaccgtgcctctacttaagaattcatgtgagggtgaaagtgtatcagaaggtgaaaagaaaaagaagcagcagaacataaatgttcagggagcttatcttcatgtaataggagattctattcagagcataggggtgatgattgggggagctattatatggtataaaccagagtggaaaatcatcgatctaatttgcactctcattttctctgtaattgtgctcaggacaaccattaggatgcttcggagtattcttgaagtattaatggagagtacgcccagagaaattgatgcaacaaggctcgagaaggggctctgtgagatggaggacgttgtcgcaatccatgaattgcacatatgggcaattacagtcggcaaagtgctcctggcttgccatgtcaagattaagtccgacgctgatgctgacacggtgctggataaggtgattgattatattaagagggaatataacattagccatgtaaccattcaaatagaaagagagtaatggcatggaaaagtttattttggctgttctactggtcattggcttctttattctttcgaatagtagtttaaaaggaaaactagatctggttaagcggttccagtatctgtttcagtttggtaaatcatggtttgcattttatggtaatagcaaggcacaaagctcttttgaaatctgattgaatcatgtgaggcaactctggcaggtggcttcgatacatagttacaggttctttcctcaaggctaggttttaaaa

SEQ ID NO: 263 - protein, 418 aa, Nicotiana tabacum
METQNLERGHVIEVRCDMAAQEKGTKICGSAPCGFSDVNTMSKDAQERSASMRKLCIAVVLCIIFMAVEVVGGIKANSLAILTDAAHLLSDVAAFAISLFSLWAAGWEANPRQSYGFFRIEILGALVSIQMIWLLAGILVYEAIARLIHDTGEVQGFLMFVVSAFGLVVNLIMALLLGHDHGHGHGHGHSHGHDHEHGHNHGEHAHSNTDHEHGHGEHTHIHGISVSRHHHHNEGPSSRDQHPHAHDGDHTVPLLKNSCEGESVSEGEKKKKQQNINVQGAYLHVIGDSIQSIGVMIGGAIIWYKPEWKIIDLICTLIFSVIVLRTTIRMLRSILEVLMESTPREIDATRLEKGLCEMEDVVAIHELHIWAITVGKVLLACHVKIKSDADADTVLDKVIDYIKREYNISHVTIQIERE

SEQ ID NO: 264 - DNA, 1457 bp, Populus trichocarpa
agttttggtattgctgtcagttaaattcagatggacgtgcgaaattcagagcatggacgtgtaattgaagtacatgtagatgttccagctgcggagaatagcctgggtgggagtaggatttgtggaggagtatcgtgtggattttcagatgctcagaccagttctaaagatgcaaaggaacgaggggcatccatgaagaaacttgggtgggcagttgggctctgtcttgtcttcatggctgttgaaattgctggaggcataaaagccaatagtcttgcaattttgaccgatgcagctcatcttttatcagatgttgcagcatttgcaatctccttgttttcaatctgggcatccggatgggaggcaactccacgtcggacttatggatattttaggattgagatacttggtgctcttatttccatccagatgatatggcttcttgcaggtatccttgtatatgaagctattgttagaattattcatgatacaggtgaagttaaaggcgcactcatgtttgctgttgctgctgttggcttactggttaatattggcatggcattcttgttgggtcacgaccatggtcacgggcacggtcatggtcacgggcacggtcatgggcacggtcacgagcatggtgagcacaatcatgaccacagtgatgatggccatagccatgagggtgatgatggccatagccatgagggtgatgatggccatagccatgaggatcatgatcatagccatgaggatcatgatcatgcacataaccacatgctgagtggagccactcatcataatcaccaccatcatgaagggagctctgaaaacaatgatgaacatcatcatacacacggagcagatcttgctgagcctctgcttagtactcacacagaagttgacaataaaacaaaaggagggagtaaacaaaagaagcagagaaatatcaatgttcagggggcctatcttcatgtattgggagactcaattcagagtgttggggtgatgattggtggggcaattatatggtataagccagagtggaagattattgatctgatatgcaccctcgcgttttcgataatcgttctaggcacaacaatcggtatgatacggaatattctagaggttctaatggaaagtacaccgagggagattgatgcaactaggcttgagaagggtctctgcgagatggatgaggtggttgccattcatgaactgcacatttgggcaataactgtagggaagtttctgttggcttgccatgttatgatcaagcctgatgctgatgctgacatggtactggacaaggttatagattacattaggagagaacacaatatcactcatgtgaccattcagatagagcgaccgtaaaccgtcagactgggtaagtgcaagttgtattggagtggctttgcctcagctttgaacttttgtaattctttgtcattgat

SEQ ID NO: 265 - protein, 446 aa, Populus trichocarpa
MDVRNSEHRVIEVHVDVPAAENSLGGSRICGGVSCGFSDAQTSSKDAKERGASMKKLGWAVGLCLVFMAVEIAGGIKANSLAILTDAHLLSDVAAFAISLFSIWASGWEATPRRTYGYFRIEILGALISIQMIWLLAGILVYEAIVRIIHDTGEVKGALMFAVAAVGLLVNIGMAFLLGHDHGHGHGHGHGHGHGHGHEHGEHNHDHSDDGHSHEGDDGHSHEGDDGHSHEDHDHSHEDHDHAHNHMLSGATHHNHHHHEGSSENNDEHHHTHGADLAEPLLSTHTEVDNKTKGGSKQKKQRNINVQGAYLHVLGDSIQSVGVMIGGAIIWYKPEWKIIDLICTLAFSIIVLGTTIGMIRNILEVLMESTPREIDATRLEKGLCEMDEVVAIHELHIWAITVGKFLLACHVMIKPDADADMVLDKVIDYIRREHNITHVTIQIERP

SEQ ID NO: 266 - DNA, 1469 bp, Populus trichocarpa
gggcatctactattatactcataatgatttatgatcggctatactattgctttcaataataggaaggagcatttacctatttatataacagataatatggtgagtcataaattaggagaatttgcacctactctcaatttccggggacatgctacggagcatccaccataccagatccatccacatgggcgtgtaaactggaagacaatggaagaacaaaatactcagcatgccccccctgttgaaacaagcgtggatattcttgatggaggggatagtggagcgagtaacgtatgtggggaagcaccttgtgtattttcagatactggaaataacctcaagaatgccaaagaacgttcaacttcaatgcgtaagctctggatagccgtggcactttgtgtagtgttcatgagtgctgaggtagctggtggcatcaaagccaatagtctggcaatcttgactgatgctgcacatttgctttcagatgttgcagcctttgctatctccttgttttcattttgggcagctggctgggaagccacaccccgtcaatcttatggatttgttaggattgaggttctcggtgcactggtttccatacagctcatctggttgcttgcagggattttggtttatgaagccattgttaggctcatccatgatacaggggaggtagatgggtttcttatgtttcttgttgctgcattcggtcttctagtgaatatcgtcatggcacttgtgttgggacatgatcacgggcatgaccatgatcacaatcatgggactggccacagccatggaatgacagttactactcatcatcgtcatcatgacgagcacccaaaagatgcgggcaatcatcataagcactcgaaagatgagcaccgtcatgctcatgaagaacatgttgagccgctgctggataaaaaggaagccaggcatgaaaagaagcaaaggaacataaatgtacaaggagcttatatccatgtacttggggattccatccagagtatcggggtcatgataggaggtgcaattgtatggtataaacctgagtggaagatagttgatgtgatctgcaccctattcttttcagttatagtcttgggtacaacaatcaaaatgcttcggaacatacttgacgtcttgatggagagcactccaagagagatagatgcaacaaagattgaaaagggattgtttgagatggaggacgtggtggctatccacgaactgcatatatgggccattaccgtgggcaagattctcctggcttgtcatgtgaaaatcaggcctgaagcaaatgcagacatggtgctagacaatttgataaactatatcagaagtgagtatagtatcagtcatgtaaccatccagatagaacgttagcagaggcaaaggaattagctagttgaatctggggcctgatgtttccgaaagtgatgatctttcatcacatgcacgcatat

SEQ ID NO: 267 - protein, 452 aa, Populus trichocarpa
MIGYTIAFNNRKEHLPIYITDNMVSHKLGEFAPTLNFRGHATEHPPYQIHPHGRVNWKTMEEQNTQHAPPVETSVDILDGGDSGASNVCGEAPCVFSDTGNNLKNAKERSTSMRKLWIAVALCVVFMSAEVAGGIKANSLAILTDAAHLLSDVAAFAISLFSFWAAGWEATPRQSYGFVRIEVLGALVSIQLIWLLAGILVYEAIVRLIHDTGEVDGFLMFLVAAFGLLVNIVMALVLGHDHGHDHDHNHGTGHSHGMTVTTHHRHHDEHPKDAGNHHKHSKDEHRHAHEEHVEPLLDKKEARHEKKQRNINVQGAYIHVLGDSIQSIGVMIGGAIVWYKPEWKIVDVICTLFFSVIVLGTTIKMLRNILDVLMESTPREIDATKIEKGLFEMEDVVAIHELHIWAITVGKILLACHVKIRPEANADMVLDNLINYIRSEYSISHVTIQIER

SEQ ID NO: 268 - DNA, 1352 bp, Populus trichocarpa
agttttgttattgctgctggttaaattcagatggaagtgcgaaattcagaacatggacgtataattgacatacatgtagatgttccagctgtgaagactagcctgggtgggagtaggatttgtgcgggagcaacatgtggattttcagatgctaaaaccagttctaaagatgcaaaggaacgaggggcgtctatgaagaaacttggatgggcagttgtgctctgtcttatcttcatggctgttgaaattgtaggaggcataaaagccaacagtctcgcgatcttgactgatgcagctcatcttttatcagatgttgcagcttttgcaatctctttattttcaatctgggcatcaggatgggaggcgactccacgccgaacttatggttattttaggattgagatacttggtgctcttatttccatccagatgatatggcttcttgcagggatccttgtgtatgaagctattgccagactgatttacgatacaggtgaagttcagggtgctctcatgtttgctgtttctgctgttggcttactggttaatattgtcatggcactcttgttgggtcatgatcacggtcacgcgcacgggcatggtgggcacgatcatggccacagtgatcatgaccatagccatgaggatcatgatcatacccataccaacagtttaagtggagccacacatcataatcaccaccatcatgaggggaactccgaagacaatggtgagcatcatgacacacatggagcagatcttgctgagcctctgcttagtagtcacacagaagttgaaaataaaacaaatggcgggcataaacaaaagaagcaacgaaatattaatattcagggggcttatcttcacgtattgggagattcaattcagagttttggggtaatgctcggtggggcacttatatggtataagccagggtggaaaatcattgatctgatatgcacccttgtgttttccataattgtgttgggcacaacaatcagtatgctacggaatattctggaggttctcatggagagcaccccgagggagattgacgcaactacgcttgagaagggtctctgcgaaatggacgaggtggttgccgtccatgaactgcacatttgggcaataactgtagggaagtttttgttggcttgccatgttatgatcaagcctgatgctgatgctgacatggtgctagacaaggttatagattacattaagagagaacacaatatcagtcatgtgaccattcagatagagcgacagtaaccatttagatgggggcaagtacaagttacatttcagtggcttagcgtcagttttgaacttttacttttaattctttgtca

SEQ ID NO: 269 - protein, 413 aa, Populus trichocarpa
MEVRNSEHGRIIDIHVDVPAVKTSLGGSRICAGATCGFSDAKTSSKDAKERGASMKKLGWAVVLCLIFMAVEIVGGIKANSLAILTDAAHLLSDVAAFAISLFSIWASGWEATPRRTYGYFRIEILGALISIQMIWLLAGILVYEAIARLIYDTGEVQGALMFAVSAVGLLVNIVMALLLGHDHGHAHGHGGHDHGHSDHDHSHEDHDHTHTNSLSGATHHNHHHHEGNSEDNGEHHDTHGADLAEPLLSSHTEVENKTNGGHKQKKQRNINIQGAYLHVLGDSIQSFGVMLGGALIWYKPGWKIIDLICTLVFSIIVLGTTISMLRNILEVLMESTPREIDATTLEKGLCEMDEVVAVHELHIWAITVGKFLLACHVMIKPDADADMVLDKVIDYIKREHNISHVTIQIERQ

SEQ ID NO: 270 - DNA, 1292 bp, Populus trichocarpa
ggtattcgtgatgttgctgtgaactttcagatggaagcacaaaatcctcagcatgggcatccagttgaaataagcgtggatattcttgatggagagatgagtggaggaagcaagggatgcggggaagcaccttgtggattttcagatactggaaataactccaagaatgccaaagaacgttcagcttcaatgcgcaagctctggatatccgtggcactttgtatagtcttcatgagtgctgaggtagctggtggcatcgaagctaatagtctggcaatcttgactgatgctgcacatttgctttcagatgttgcaggctttgctatctccttgttttctttatgggcagctggctgggaagccacaccccgccaatcttatggattttttaggattgagattctcggtgcattggtttccatgcagctcatctggttgcttgcagggattttggtgtatgaaaccattattaggctcatccatggtactagtgaggtaaatgggttccttatgtttcttgttgctgcatttggccttctggtgaacatcataatggctcttgtgttgggacatgatcatgggcctgaccatgatcacaaacatgggactggccacagccatggaaccacagttagtactcataaccatcatcacgtggagcacccaaaacatgatgacaatcatcatgaccactcgaacaatgagcaccatcatgctcatgaagatcatgttgagccgctgctggataaaggggaagccatgcatgaaaagaagcaaaggaacataaatgtacaaggagcttatctccatgtacttggggattccatccagagtattggggtaatgatcggaggtgcaattatatggtataagcctgagtggaagataattgatctgatctgcaccctaatcttttctgttatagttttgggtacaacaatcaaaatgctacggaacatacttgaagtcctgatggagagcactccaagagagatagatgctacgaagattgaaaagggtctgctggagatggaggaggtgatggctatccacgaactgcatatatgggccattaccgtgggcaagattctcttggcttgtcatgtgaaaatcatgcccgaagcaaatgcagacatggtgctagacaatgtgatcagctatctcagaagggaatacaatataagtcatgtaaccatccagatagagcgttagcagaggtaaaggaatttactagttgaatctggggcgtgatgtttctgagagttatgctttttcaatcacatgaacgcata

SEQ ID NO: 271 - protein, 393 aa, Populus trichocarpa
MEAQNPQHGHPVEISVDILDGEMSGGSKGCGEAPCGFSDTGNNSKNAKERSASMRKLWISVALCIVFMSAEVAGGIEANSLAILTDAAHLLSDVAGFAISLFSLWAAGWEATPRQSYGFFRIEILGALVSMQLIWLLAGILVYETIIRLIHGTSEVNGFLMFLVAAFGLLVNIIMALVLGHDHGPDHDHKHGTGHSHGTTVSTHNHHHVEHPKHDDNHHDHSNNEHHHAHEDHVEPLLDKGEAMHEKKQRNINVQGAYLHVLGDSIQSIGVMIGGAIIWYKPEWKIIDLICTLIFSVIVLGTTIKMLRNILEVLMESTPREIDATKIEKGLLEMEEVMAIHELHIWAITVGKILLACHVKIMPEANADMVLDNVISYLRREYNISHVTIQIER

SEQ ID NO: 272 - DNA, 1820 bp, Oryza sativa
gcatcctaccccccgttctctcctccccatctccaacgcacgcacgcgccatcaccaccacctcgacgccggcggcgacgaccacggcgacggcaacggcggcggcggcagagaagccctcctcatccccaagatggacagccataactcagcacctccccagattgctgaagtgagaatggacatctcatcatctacttctgtagcagctgggaacaaagtttgcagaggtgctgcttgtgacttttctgattccagtaatagctcaaaagatgcaagggagagaatggcgtcaatgaggaagctcattattgctgtgatcctttgcatcatattcatggcggtcgaagtggttggaggtatcaaagcaaacagtttggcaatcttgactgatgcagcccatctcctttcggatgttgcggcctttgccatatctttgttctctctttgggcagctggatgggaagctacaccacagcagtcatatgggtttttccgtatagaaattcttggtgccctggtttctattcagctcatatggctccttgctggtattcttgtctatgaagctattgtaaggctcattaatgaaagtggtgaggtccagggctccctcatgtttgctgtctcagcatttggcttatttgttaacatcataatggctgtcttgcttggtcatgaccatggacatggacacggacatggtcatgggcatggacattcccatgaccatgatcatggtggttctgaccatgaccatcaccaccatgaagatcaagagcatggccatgtacatcaccacgaagatggccatggtaattcaattaccgtcaatctccatcaccatccaggcactggacaccaccaccatgatgctgaggaaccattgctcaagagtgatgctggttgtgacagcacccaatctggtgccaaggatgccaagaaggctcgtcgtaatatcaatgtacacagtgcttatctgcatgtgcttggggattcaatccagagcatcggtgtgatgattggaggggctatcatctggtacaagcccgagtggaagattattgatctcatctgcaccctcatcttctccgtgatcgtactcttcaccacaatcaagatgctgcgcaacatccttgaggtcctgatggagagcacgccccgcgagatcgatgccaccagccttgagaatggcctccgcgacatggacggtgtggttgcagtacatgagctgcacatctgggccataacggtggggaaggttctcctggcgtgccatgtgacaatcactcaggacgcagacgctgatcaaatgctggacaaggtgattgggtacatcaagtctgagtacaacatcagccatgtgaccattcagattgagcgcgagtaggcttgaccgcttgagacaggtaggtagtgttgatgatagaacggatcatcttcatctcatctcatgggaccaacttatcaggaacctgtttcactggttttatgcagttactgttagctctgcagtgcaaatcagatcagcagagtccaacaattcctgcaggttcatctgaatgttagcttctgatgctgtttattactataagtacgtgttattagtactatcttagtcaattaggtgagttgatgttaatcagtttcgtagtcggttgtattcacatgggtgcagttttcagacaagttttcaggcacctgtgagtacgtcaacctgccttctgcgtctgtagtctagcgcccagccgtactagtttttatgtaaatctgcactggcatgggaaataataaccaagtttcgtttggccttataatga

SEQ ID NO: 273 - protein, 418 aa, Oryza sativa
MDSHNSAPPQIAEVRMDISSSTSVAAGNKVCRGAACDFSDSSNSSKDARERMASMRKLIIAVILCIIFMAVEVVGGIKANSLAILTDAAHLLSDVAAFAISLFSLWAAGWEATPQQSYGFFRIEILGALVSIQLIWLLAGILVYEAIVRLINESGEVQGSLMFAVSAFGLFVNIIMAVLLGHDHGHGHGHGHGHGHSHDHDHGGSDHDHHHHEDQEHGHVHHHEDGHGNSITVNLHHHPGTGHHHHDAEEPLLKSDAGCDSTQSGAKDAKKARRNINVHSAYLHVLGDSIQSIGVMIGGAIIWYKPEWKIIDLICTLIFSVIVLFTTIKMLRNILEVLMESTPREIDATSLENGLRDMDGVVAVHELHIWAITVGKVLLACHVTITQDADADQMLDKVIGYIKSEYNISHVTIQIERE

SEQ ID NO: 274 - DNA, 1326 bp, Thlaspi caerulescens
gcccaacggagagaccgagagagcaaaggaagggaagggacccagaaaagatggagtcttcaagtcacatcattgaggttaatggaggaagatctgatgaagaaagaagggctgtggcaagtaaagtctgtggagaggcaccgtgtgggttctcagatgccaagaatgtttcaggggataccaaagaacgcaatgcttctatgcggaagctctgtatcgcggtggtgttatgtcttgtgttcatgagcgttgaaatcgttggtggaatcaaagccaatagtttggctataatgacagatgcagcacatttgctctctgacgttgctgcctttgccatctctctcttcgccttgtgggctgctggttgggaagcgacgccgaggcagacttacgggttcttcaggattgagatcttgggagctcttgtgtctatccagctcatttggttgcttactgggatcttggtttatgaagccatatcaaggcttcttaccgagaccagtgaggttaatggattccttatgtttgctgttgctacgtttggtctgctggtgaatatcataatggctgtgatgcttgggcatgatcatggtcatagtcatggtcatggtcatgaccatgaaaaccatagccatggggtgactgttaccactcatgatcatgatcccactcatgatcatgatcatgatcatgatcacgatgatggtcatggtcatagtcatggagaggacaatcaggatgaagctcatggagacgttactgagcagctgttggagaaaccaaagcaggagaaagagaaaaagaaaaggaacatcaatttgcaaggagcttatcttcatgttcttggtgattcaatccagagcgttggtgttatgattggaggagctgccatttggtacaacccgaaatggaagataattgatctgatctgcactcttgccttttcggttatcgtcttggggacaaccatcaacatgattcgaaacattcttgaagtgttgatggagagtacgcctagagagattgacgctacaaagctcgaaaagggtttgctcgaaatggaagaagtggtggctgttcatgagcttcacatttgggctatcacagtgggaaaggttttacttgcttgccatgtcaatgttacaccacaagcagatgcagatatggtgctcaacaaggtggttgattacatccgcagagagtacaatatcagtcatgtaaccatacaaatcgagcgctgaaagcaaagcaaagcaaaagctaagatcttgatgtgttttttgtatcagcattctcattatcaataattttttctaccctttttgc

SEQ ID NO: 275 - protein, 396 aa, Thlaspi caerulescens
MESSSHIIEVNGGRSDEERRAVASKVCGEAPCGFSDAKNVSGDTKERNASMRKLCIAVVLCLVFMSVEIVGGIKANSLAIMTDAAHLLSDVAAFAISLFALWAAGWEATPRQTYGFFRIEILGALVSIQLIWLLTGILVYEAISRLLTETSEVNGFLMFAVATFGLLVNIIMAVMLGHDHGHSHGHGHDHENHSHGVTVTTHDHDPTHDHDHDHDHDDGHGHSHGEDNQDEAHGDVTEQLLEKPKQEKEKKKRNINLQGAYLHVLGDSIQSVGVMIGGAAIWYNPKWKIIDLICTLAFSVIVLGTTINMIRNILEVLMESTPREIDATKLEKGLLEMEEVVAVHELHIWAITVGKVLLACHVNVTPQADADMVLNKVVDYIRREYNISHVTIQIER

SEQ ID NO: 276 - DNA, 2083 bp, Zea mays
cgctgttcgagcagagccccatcccctgatccccgtgccaggccgctcggccctcgacgccgtgagtcaggcaggcaggcgcctctttctgtccctccactcgggtctccacgccgccgccgccgccgccgcctcgaccgccccacgcatccgccgctcctctacccatcctcggcccgcggcccagggagaagaccgcacgggcgggcgagatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcaaacagtcttgccatcttaactgatgcggcgcaccttctttctgatgtggcagcatttgccatatcgttattctctctctgggctgctggatgggaagcaacaccgcagcagtcatatgggttcttccggattgagattcttggtgccttggtctccattcagctcatatggctacttgctggcatactggtatatgaggctattgtaaggctcattaacgagagtggcgatgtgcagggctccctcatgtttgctgtgtcggcgtttggactgtttgtcaacattataatggctgtattgctaggccatgaccacgggcacggccatggacacagccatggacatccacatgaccatggtcatggtgattcagacgatggccattctcaccatgaagaaccagaacagggccatgttcatcatcatgagcatagccatggaagttctattactgtcacaacacatcaccaccaccactcaggcactggacaacaccatgacgctgaggagccactgatcaagcacgaggccgactgtgagggcacccaatctgctgctaagaagcctcgacgcaatataaacgtacacagcgcttaccttcatgtgcttggggactccatccagagcatcggggtgatgatcggcggggctatcatctggtacaagcccgagtggaaaatcatcgatctgatctgcaccctcatcttctcggtggtcgtgctgttcaccacgatcaggatgctgcgcaacatcctcgaggtcctgatggaaagcacgccccgtgagatcgacgccaccaggctggagagggggctctgcgagatggaaggcgtggttgccgtccacgagctgcatatctgggccatcacagtggggaaggtgctactggcttgccatgtgacggtcgccagggaagccgacgcagacgagatccttgacaaggtgattgggtacatcaagacggagtacaacatcagccatgtgaccattcaggtcgagcgtgaatagagggggagctgtcttttgggctgtcagggcataaatggcgtcacgccttcactggttatcttactctgtcggttaaaacttttttttggcacctgggaaggcatcaggcagccatcggagtcttgatgtgcttgcaagttcatctgtggttcaagctttgatggtcagtagtgttatctgttactactagtctattaggcgggggtaggcgtcaaccagtgtgtacgggtttgattttcggtcatgctgttaacagcattgcggttcgtcgaactggatatgtagtttagtacgctgtgtcatcacctcttgtgtaagggaacgcttcttttctgtggtatggaagatgtgaacttcgtgattggcctgttaccgtttgtactgagcatgcttggacgtgttctctcggttgactcgactgtatgcttatggatgggggtctcaagcagatttgttgcacaattgaagccagccagatatccctctgtgcagattttcagataactgacaaaggctatacaccccgacagaacaactagcaagcaattcatgcataatctcaccagatagtgcgatgatctgtaaagagttgtccccccaaaagagaataagaggttgtttgtttg

SEQ ID NO: 277 - protein, 414 aa, Zea mays
MENHNPLHSQIAEVKMDISASASVASGNKFCKGGACDFSDSSNSSKDAKERSTSMRKLIIAVILCIIFMTVEVVGGIKANSLAILTDAAHLLSDVAAFAISLFSLWAAGWEATPQQSYGFFRIEILGALVSIQLIWLLAGILVYEAIVRLINESGDVQGSLMFAVSAFGLFVNIIMAVLLGHDHGHGHGHSHGHPHDHGHGDSDDGHSHHEEPEQGHVHHHEHSHGSSITVTTHHHHHSGTGQHHDAEEPLIKHEADCEGTQSAAKKPRRNINVHSAYLHVLGDSIQSIGVMIGGAIIWYKPEWKIIDLICTLIFSVVVLFTTIRMLRNILEVLMESTPREIDATRLERGLCEMEGVVAVHELHIWAITVGKVLLACHVTVAREADADEILDKVIGYIKTEYNISHVTIQVERE

SEQ ID NO: 278 - DNA, 2194 bp, Oryza sativa; identical to SEQ ID NO: 188

SEQ ID NO: 279 - DNA, 56 bp, Artificial sequence
  primer: prm09216
ggggacaagtttgtacaaaaaagcaggcttaaacaatggagtcttcaagtccccac

SEQ ID NO: 280 - DNA, 50 bp, Artificial sequence
  primer: prm09217
ggggaccactttgtacaagaaagctgggttagcttttagcgctcgatttg

SEQ ID NO: 281 - DNA, 1513 bp, Oryza sativa
tttgtacaaaaaagcaggcttaaacaatggctgtcactagaattggtcttgctggccttgcggtcatggggcagaaccttgccctcaacattgcagagaaagggttccctatctctgtctacaacaggacgacttctaaggttgatgagaccgttcagcgcgccaaggtagaaggaaaccttcctgtgtacgggttccatgaccctgcatcctttgtgaactccattcagaagccacgtgttgtcatcatgcttgtcaaggctggtgcaccagtggaccagaccattgcaactcttgcagcacacttggagcagggtgactgtattattgatggaggaaatgagtggtacgagaacactgagaggagggagaaggcaatggaggagcgtggcctcctctatcttgggatgggtgtttccggaggagaggagggtgcccgcaatggcccgtccttgatgcctggtggctcattcgaggcgtacaagtacattgaagatattcttctcaaggtggctgcccaggttcctgatagtggcccgtgcgtcacatacattggcaaaggtggatctggaaactttgtcaagatggttcacaacggaattgagtatggtgacatgcaactgatttctgaggcatatgatgttctcaagtcagttggtaagctcacaaacagtgagctgcagcaggtgttttctgagtggaacaagggtgagctcctcagtttcctgattgagatcacagccgacatatttagcatcaaggatgaccagggttcaggccacctggtcggcaaggtcctggacaagactgggatgaagggaactgggaagtggactgtgcagcaggccgcagagctttctgtggctgctcctacaattgaggcatccttggattccaggttcctcagtgggttgaaggatgagcgtgttgaggctgccaaggtcttccaaggtgacttctccagcaacttgccagtggacaaggcacagctgattgaagacgtgaggcaggctctttacgcctcgaagatctgcagctacgctcagggcatgaacatcatcaaggccaagagcatggagaaagggtggagcctcaacctcggtgagctagcgaggatctggaagggagggtgcatcatccgtgccatcttcctggaccgcatcaagaaggcctacgacaggaactccgacctcgccaacctgctcgtggaccctgagttcgctcaggagatcatggacaggcaagcggcatggcgcagggtggtctgccttgccatcaacaatggcgtcagcaccccaggcatgtcggcgagtctcgcgtacttcgactcctaccggagggacaggctgcctgccaacctggtgcaggcacagagggactatttcggggctcacacctacgagagggtcgacatgcccggctccttccacaccgagtggttcaagatcgcgcgtgctgctaagatgtgaaatgcttcaaattttcggtaatacccagctttcttgtacaaagt

SEQ ID NO: 282 - protein, 480 aa, Oryza sativa
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVGKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 283 - protein, 175 aa, Artificial sequence
  domain 6PGD
TRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGK

SEQ ID NO: 284 - DNA, 56 bp, Artificial sequence
  primer 11
ggggacaagtttgtacaaaaaagcaggcttaaacaatggctgtcactagaattggt

SEQ ID NO: 285 - DNA, 50 bp, Artificial sequence
  primer 12
ggggaccactttgtacaagaaagctgggtattaccgaaaatttgaagcat

SEQ ID NO: 286 - DNA, 2194 bp, Oryza sativa; identical to SEQ ID NO: 188

SEQ ID NO: 287 - DNA, 1809 bp, Aquilegia formosa
gtttgtgtgtcgttgaacacttgaagtgaatttgatttccaacaacaacaacaaaaatcgaaattctatatttaacttgatcgaaatcttagattttcttagttactgagatttctcaaccaatcttacaagtcttcagttctgaaagaaagaaagaaaatggcaacccccccttcttctagtctctcaagaattggcctagcaggccttgcagtaatggggcaaaatcttgcactcaacattgcagagaaagggtttccgatttctgtttacaatcgaactacctctaaagttgatgagactgttgagcgagctaagagggaaggagatctacctttgtttggtttccatgatcctgaatcctttgttaattcaattcaaaagcctagggttataattatgcttgttaaggctggtgcccctgttgaccaaacaatcaaaactctttctgtttacatggaaaaaggtgattgtattattgatggtggtaatgagtggtatgaaaacactgagaggagggagaaggctatggctgaattaggtttactttatttaggaatgggagtatcaggtggtgaagagggtgcaagacgtgggccttccatgatgccgggtgggtccttcgaggcctataagaacattgaagacatactaatcaaggtggcagctcaggttcctgatagtggcccatgtgttacttacatagggaagggaggatctggcaattttgttaagatggttcacaatgggattgaatatggtgatatgcaactgattgctgaggcttatgatgtgctgaaatcagttgggaagctatccaatgaagaattacactctgtgttctcagagtggaacaagggagaacttctgagtttcttgattgagatcacagcagatatctttaaaatcaaggatgacaagggggaaggacatttggttgacaaagttttggacaaaactggtatgaagggtactggaaagtggaccgtgcagcaagctgcagacctctcaattgcagctccaaccatagcgtcatctttggatgcaaggttccttagtgggttgaaggaagaaagagttgaagctgctaaaatctttaaatcaggtggctttggtgacatattgactgatcaagtagtcaacaaggagaaattgattgatgatgtcagacaagctctttatgcagccaaaatctgtagctatgctcaggggatgaatttgatacgtgcaaaaagtatcgagcaaggatgggacctgaagttaggggagcttgcaaggatttggaagggaggttgcatcatccgtgctgtctttctggaccgtatcaagaaggcctatgataggaaccctgatcttgcaaaccttcttgtggacccagaattcgcaaaggagatgattgaccgtcagtctgcttggcgacgagttgtctgtcttgctatcaattcaggaatcagtaccccgggtatgtcaaccagtcttgcttatttcgatacttacaggagagctagacttccagcaaatttggtccaagctcaaagagattactttggggctcacacttacgagaggactgatgtgccaggatcgttccatactgaatggttcaagattgctaaaggttcaaaaatttgaacattctgtttgtttccttttaattagtgtaatgatttcctttgaacaaaataatgatcccttgggacagatatattttgtagaagtattgtgaaaccattgtgtggaatcattgtccgaattgaatttcagattcaatgaaaatttccatttgtttttttgtctgctgtacactgt

SEQ ID NO: 288 - protein, 490 aa, Aquilegia formosa
MATPPSSSLSRIGLAGLAVMGQNLALNIAEKGFPISVYNRTTSKVDETVERAKREGDLPLFGFHDPESFVNSIQKPRVIIMLVKAGAPVDQTIKTLSVYMEKGDCIIDGGNEWYENTERREKAMAELGLLYLGMGVSGGEEGARRGPSMMPGGSFEAYKNIEDILIKVAAQVPDSGPCVTYIGKGGSGNFVKMVHNGIEYGDMQLIAEAYDVLKSVGKLSNEELHSVFSEWNKGELLSFLIEITADIFKIKDDKGEGHLVDKVLDKTGMKGTGKWTVQQAADLSIAAPTIASSLDARFLSGLKEERVEAAKIFKSGGFGDILTDQVVNKEKLIDDVRQALYAAKICSYAQGMNLIRAKSIEQGWDLKLGELARIWKGGCIIRAVFLDRIKKAYDRNPDLANLLVDPEFAKEMIDRQSAWRRVVCLAINSGISTPGMSTSLAYFDTYRRARLPANLVQAQRDYFGAHTYERTDVPGSFHTEWFKIAKGSKI

SEQ ID NO: 289 - DNA, 1820 bp, Aquilegia formosa
gtcagctatttctctttctctgtcaaaaagcttgtgttcagtcaatcgaaattcatccattgttctgaatcttgctgttttcttctctatataattcgattcaaacatccattttctacaatacccatttcttagatttcgtttattgcacagatatctcaacaaatcttcaaatttcttataagaaaatatggctgctccttcgcaaaatctctcaagaataggccttgcaggactggctgtaatgggacaaaatcttgccctcaacattgctgagaaaggattcccaatctctgtttacaaccgaaccacctccaaagtcgatgagactgtcgaacgagccaaaaaggaaggcaatctccctttatatggcttccatgaccctgagtcctttgttcagtcgatccaaaaacctcgagtgataatcatgcttgttaaggctggggcaccagttgaccaaactatcaaaacactctcagtttacatggagaagggtgattgtataattgatggtggtaatgagtggtacgagaacactgagaggagagaaaaggcaatggctgaattgggtctactctatctcggaatgggagtttcaggtggtgaagagggtgccagaaatggaccttctatgatgcctggaggatcatatgaggcctacaagtatattgaagacattcttcttaaggtgtcagcccaagttcctgacagtggtccatgtgttacttacataggcaaagggggatcaggcaatttcgttaagatggtccacaatgggatcgaatatggtgatatgcaactgatttctgaagcttatgatgtactaaaatcagttgggaagctttccaatgaggaattacaccatgttttttcagagtggaacaagggggaacttcttagcttcttagtcgagattactgctgatatttttaagattaaagatgacaagggagaaggatatctggttgacaaggttttggacaagactggcatgaagggtactggaaaatggacggttcagcaagctgccgatctatcaattgcagctccaacaatagcttcgtctttagatgcaaggttccttagtgggttgaaggatgagagagtagaagctgccaatgtcttcaaatctggaggttttggtgacattttaactgatcaaactgtggataaggagaaattaattaatgacgtaaggcaagctctttatgcagccaagatctgtagttatgcacagggaatgaatctcatccgtgcaaagagcgtcgaacagggttgggacttgaagttgggagagttggccagaatttggaagggaggctgcattatccgtgctgtgtttttggatcgtattaagcaagcctatgacaggaatgctgatcttgcaaatcttcttgtcgatcccgagtttgctaaggagatgattgaacgacagtctgcttggcggcaagtagtttgtcttgctatcaactctggcatcagcactcctggtatgtcatccagtcttgcatactttgacacttacaggagggctaggctccctgctaatttggtccaagcccagagagattactttggagctcacacctatgaaaggactgacataccaggatccttccatactgagtggtttaagcttgctaaacaatcttagaactaagccttcgcatatgtctaatatattgggttcagctttcaccacaccaatgttgaaatctagtgtcccaaattagtttgataaattcttgtctgtgttcgtctttttctgtatttttgtcatttgctgctttctagttgtctgatgtactctgtcctttgat

SEQ ID NO: 290 - protein, 487 aa, Aquilegia formosa
MAAPSQNLSRIGLAGLAVMGQNLALNIAEKGFPISVYNRTTSKVDETVERAKKEGNLPLYGFHDPESFVQSIQKPRVIIMLVKAGAPVDQTIKTLSVYMEKGDCIIDGGNEWYENTERREKAMAELGLLYLGMGVSGGEEGARNGPSMMPGGSYEAYKYIEDILLKVSAQVPDSGPCVTYIGKGGSGNFVKMVHNGIEYGDMQLISEAYDVLKSVGKLSNEELHHVFSEWNKGELLSFLVEITADIFKIKDDKGEGYLVDKVLDKTGMKGTGKWTVQQAADLSIAAPTIASSLDARFLSGLKDERVEAANVFKSGGFGDILTDQTVDKEKLINDVRQALYAAKICSYAQGMNLIRAKSVEQGWDLKLGELARIWKGGCIIRAVFLDRIKQAYDRNADLANLLVDPEFAKEMIERQSAWRQVVCLAINSGISTPGMSSSLAYFDTYRRARLPANLVQAQRDYFGAHTYERTDIPGSFHTEWFKLAKQS

SEQ ID NO: 291 - DNA, 1828 bp, Aquilegia formosa
tttcctttcaacaaagcttcctttctcagctctactgactttggaagctcgtttctttattccggtgatttcaattcattttccgatatcaaacgagttattagccatggacgcatcagcagcaggtctctcacgcattggactagctggtctagctgtcatgggtcagaatcttgctctcaacatagcggataaaggattccccatctctgtttacaatcgtacaacttctaaagtcgatgaaaccctagaacgagctaagcacgaaggagatctccctctcactggtcattattcaccacgtgatttcgttctctccatccaacgacctagatctgtcgtcatcctcgtcaaagccgggtcccctgtggatcagacaatttctgctctctctgagtacatggagtcaggtgacacaatcattgatggtggcaatgaatggtatgagaataccgagcgccgtatgcgtgaagttgctgataaaggtattctttatttgggcatgggtgtgtcaggcggtgaagagggtgccaggaatggaccttcccttatgcccggtggatcctaccaagcttacttgaatgttgaagacattgtgaaaaaggttgctgcacaagtggaggatggcccttgcgtcacctacataggtgaaggtggctcaggtaattttgttaagatggtccacaatggcattgaatatggtgacatgcaattgatttcagaggcttatgatgtgttaaagaatgttggaggactgtccaattccgagttggcagacatttttgctgagtggaatagaggagagcttgaaagctttttgattgagataacggctgatatatttaaggtacaagatgaacatggtaatggcgaattagttgataaaattttggataagacggggatgaaggggacagggaaatggacggttcagcaggcagccgaattgtctgttgctgctccaaccattgctgcgtctttggattgtcggtatttgagtggtttgaaagaggagagagaggttgccgctgcagttttgaaggaagcaggcatgcaggacgtgtttggagctgcgatgccaaatattgataagaagagattgattgatgatgttagacaagcgttgtatgcatcaaagatatgtagttatgcgcaaggaatgaacttgctgagagccaagagtgtagagcaaagttggaatctcaactttggtgaactagcaaggatttggaaaggtggttgtattatacgggctgtgttcttggaccgaattaagaaagcgtaccaaaggaatccacaattggcaagtttgattgttgatccagactttgcaaaggagatggtgcagaggcaggcagcgtggagaagggttgtagggttggctatccaagcagggattagcactccaggaatgtgtgctagccttgcttattttgacacctataggcgtgcgagacttcctgcaaaccttgtccaggcacagagagatttgtttggggctcatacatatgaacgcattgatcgtccaggagccttccacactgagtggacaaagcttgcaaggcagggcaagactggtatgggtgttttacactgagtttatcttctacattcttgcaattcggattggttaaaatgggttgacattgttcgttaattttaattgggcgagttgcacaatgtattcactgcctaggcctttatagttgttgttttgccttgaagtttttgttgtcaataagagatgcatctgcctattgagcttggttcggctatattgtgatttttctatgaattctgtcctttgcaatagatgtagataaggaaa

SEQ ID NO: 292 - protein, 496 aa, Aquilegia formosa
MDASAAGLSRIGLAGLAVMGQNLALNIADKGFPISVYNRTTSKVDETLERAKHEGDLPLTGHYSPRDFVLSIQRPRSVVILVKAGSPVDQTISALSEYMESGDTIIDGGNEWYENTERRMREVADKGILYLGMGVSGGEEGARNGPSLMPGGSYQAYLNVEDIVKKVAAQVEDGPCVTYIGEGGSGNFVKMVHNGIEYGDMQLISEAYDVLKNVGGLSNSELADIFAEWNRGELESFLIEITADIFKVQDEHGNGELVDKILDKTGMKGTGKWTVQQAAELSVAAPTIAASLDCRYLSGLKEEREVAAAVLKEAGMQDVFGAAMPNIDKKRLIDDVRQALYASKICSYAQGMNLLRAKSVEQSWNLNFGELARIWKGGCIIRAVFLDRIKKAYQRNPQLASLIVDPDFAKEMVQRQAAWRRVVGLAIQAGISTPGMCASLAYFDTYRRARLPANLVQAQRDLFGAHTYERIDRPGAFHTEWTKLARQGKTGMGVLH

SEQ ID NO: 293 - DNA, 1809 bp, Arabidopsis thaliana
ggctccatcgacgagtccgtcattttcacagtataaatatctccacccactctctctcatcactcccactacctcatttttctctctctacctaaccaatcctaagctcatctctctatctccaatggagtccgccgcactatcccgaatcggtctcgccggactcgccgtgatgggccaaaacctcgccttaaacatcgccgagaaaggtttcccaatctcagtctacaatcgaaccacttccaaagtcgacgaaaccctagatcgagccgccgtcgaaggaaacctcccagtctccggccaatactctccccgcgatttcgtcctctcgatccaacggcctagatctctcatcatcctcgtcaaagctggagctcccgttgaccaaacaatcgacgccttctccgaatacatggagccaggagattgcatcatcgacggtggaaacgaatggtatcagaacacagagcgacggatctccgaagctgagcaaaaaggattgctctatttaggtatgggagtctccggcggcgaagaaggagctcgtaacggtccttcgttaatgcctggtggatcatttcaagcttatgataacatcaaagatattttggagaaagtcgcagctcaagttgaagatggaccttgtgttacttacatcggagaaggtggatctggaaatttcgtgaagatggttcataatgggattgagtatggagatatgcaattgatctctgaagcttatgatgtgttgaagaacgttggtggattaagcaacgaggagcttgctgagattttcactgagtggaattcaggtgagcttgagagtttcttggttgagataacttctgatatatttagggttaaggatgagtttggtgatggagagttagttgataagattttggataagactggtatgaaaggtactgggaaatggacggtgcagcaagcggcggagctgtctgttgcagctccgacgattgctgcttcgttggattgtaggtatttgagtgggttgaaagatgagagggagaatgcagcgaaagtgttgagggaagctggattgaaagaagagattggttctgcgtcgagtggaatcgataagaagagattggttgatgatgttaggcaagctttgtatgcttccaagatttgtagttatgctcaagggatgaatttgcttagagctaagagtttagagaagagttggaacttgaattttggtgaattggctaggatttggaaaggtggttgtattataagagcggttttcttggataggatcaagaaagcttaccagaggaacccggacttggctagtcttgtggttgatcctgagtttgctaaagagatggttcagagacaagctgcttggagaagagttgttggtttggctgtttctgctgggattagcacgcctggaatgtgtgctagtcttgcgtatttcgatacttatagacgtgctagattgccggcgaatctggttcaggcgcagagagatctctttggagctcacacttatgagagaaccgatcgtcctggtgcgtaccatactgaatggactaagcttgccaggaagaaccattgaaaaatccctttctgtttttgtaaaagccctatttgtcttgcttatttttgagcaattggaaatgggatttcaaaccacattgtttaacacgagtattttgttcagatttcagaataagaaatgcagcagcaccttgatttttgtttttgtttctgaacatctttgcttttaaatttgtaaaacatatctcccctgtctttaatagatcgaatgtctagacg

SEQ ID NO: 294 - protein, 487 aa, Arabidopsis thaliana
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNSGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNH

SEQ ID NO: 295 - DNA, 1828 bp, Arabidopsis thaliana
actttggtagcagtggtgcgaatcagaccgttcatttgctatatatctgctacaaacaaacatcactaatctctgcaatttttactctcctccttcacgtcttttcctcttaattttttctaggaaaattctcaaatccatctccgcgatacgaacagagagaagaagacttagaaaaatggctgttcaacctacaagaataggtctagctggacttgctgtgatgggtcagaacctagctctcaacattgcagagaaaggcttcccaatctctgtttacaacagaactacttccaaagttgatgagaccgtcgaacgagccaaaaaggaaggcaatcttcctctttacggcttccatgaccccgagtcttttgtcaagtccattcagaagccacgcgttattatcatgcttgttaaggctggttctcccgttgaccagaccatcaagaccctctctgcttatttggagaaaggtgactgtattgtcgatggtggtaatgaatggtatgagaacactgagaggagagaaaaagccgtggcggagaacggtttcctctaccttggaatgggagtttctggtggtgaagaaggtgctcgtaatggcccatctatgatgcctggaggctcttatgaagcctacaagaatatcgaagacattgttctcaaggttgctgctcaggttagggatagtggtccctgtgtgacttatatcggtaagggcgggtctggaaactttgtcaaaatggtccacaatgggatcgagtacggtgatatgcagctgattgcagaagcttatgacgtcctcaagtctgttggtaaattatcgaatgaggagcttcacagtgtcttctctgactggaacaaaggtgagcttgagagtttcttggtagagatcacagcagatattttcgggatcaaggacgataagggagatgggcatttggttgacaaggtcttggacaaaaccggcatgaaaggcacaggaaagtggaccgtgcagcaagctgctgagctatctgttcctgctcccaccattgaatcctctcttgatgcgaggttccttagcgggcttaaagatgaacgtgtgcaagcagctaaagtcttcaaggcaggtgggtttggagatatcttgaccgatcagaaagttgacaagaaacagctagtcgatgacgtgaggaaggctctttacgcatccaaaatctgcagctacgcacaaggcatgaaccttatccgtgccaagagcatagaaaaggggtggggattgaagctaggtgagttagctagaatctggaaaggaggctgcatcatcagagcaatcttcctagacaggatcaagcaagcttatgacaggaacgcagagctagctaacctcttggtggatccagagtttgcgaaagagataatcgagagacagtccgcgtggagaagagtcgtctgcttagctatcaactcgggtatcagcacaccgggtatgtctgcgagtctagcctactttgattcttacaggagagagagattgccggcaaatctagtccaagcacagagagactactttggtgctcatacatatgaaaggactgatgtggaaggatctttccacaccgagtggttcaagattgcaagacaatctaagatctgagatctctcatcctcttgtattcttcttctccttcaataataagttccacacagtatgtttctttcctcaatgtgtgagataccttggcttatttatgattgtagaactgagtttctcatctttgtgtttctttttcttaaaaagattaaaactgaagtctttggttataattttttacttttggtttca

SEQ ID NO: 296 - protein, 486 aa, Arabidopsis thaliana
MAVQPTRIGLAGLAVMGQNLALNIAEKGFPISVYNRTTSKVDETVERAKKEGNLPLYGFHDPESFVKSIQKPRVIIMLVKAGSPVDQTIKTLSAYLEKGDCIVDGGNEWYENTERREKAVAENGFLYLGMGVSGGEEGARNGPSMMPGGSYEAYKNIEDIVLKVAAQVRDSGPCVTYIGKGGSGNFVKMVHNGIEYGDMQLIAEAYDVLKSVGKLSNEELHSVFSDWNKGELESFLVEITADIFGIKDDKGDGHLVDKVLDKTGMKGTGKWTVQQAAELSVPAPTIESSLDARFLSGLKDERVQAAKVFKAGGFGDILTDQKVDKKQLVDDVRKALYASKICSYAQGMNLIRAKSIEKGWGLKLGELARIWKGGCIIRAIFLDRIKQAYDRNAELANLLVDPEFAKEIIERQSAWRRVVCLAINSGISTPGMSASLAYFDSYRRERLPANLVQAQRDYFGAHTYERTDVEGSFHTEWFKIARQSKI

SEQ ID NO: 297 - DNA, 1813 bp, Arabidopsis thaliana
accaccaacctccgtcaaaaccctaaaccactatctctctctctctcttcatatcgcaacaatggagtccgtcgctctatctcgcataggtctcgccggtctcgcagtcatgggacaaaacctcgccttaaacatcgccgataaaggattcccaatctccgtctacaatcgaaccacttccaaagtcgacgaaaccttagatcgtgcctccaacgaaggaaaactcccagtcgctggtcaatactcgcctcgcgatttcgttctctcgatccaacggcctagatccgttatcatccttgtcaaagccggtgctcccgttgaccaaaccatctctgctctctctgaatacatggagcctggtgattgtatcatcgacggtggaaatgagtggtatcagaacacagagcgacgaatcgttgaagctgagaagaaaggattgctttatttaggtatgggagtctccggtggtgaagaaggagctcgtaatggtccttctcttatgcctggtggatctttcactgcgtataacaatgttaaagatattcttgagaaagttgctgctcaagtcgaagatggtccttgtgttacatacattggagaaggtggatctgggaattttgtgaaaatggttcataatgggattgaatatggtgatatgcagctgatttcggaggcgtatgacgtgttgaagaacgttggtggattgagtaatgatgaattggctgagatcttcacggagtggaatcgaggtgagcttgagagtttcttggttgagattacttcggatatatttagggttaaggatgattatggtgatggagagttagtggataagattttggataagactggtatgaaaggtacagggaaatggacggttcagcaggcggctgagctttctgttgcggcgcctacgattgctgcgtcgttggattgtagatacttgagtggattgaaggatgagagggagaatgctgctaaagttttggaagaagctggattgaaggaggatatcggttctgcgtctcgtggtgttgataagaagaggttgattgatgatgtgaggcaagctttgtatgcttctaagatctgtagttatgctcaagggatgaatttgcttagggctaagagtttagagaaaggttgggacttgaatttgggtgaaatggctaggatttggaaaggtgggtgtattatcagggcggttttcttggacaggatcaagaaagcttaccagagaaacccgaatttggcgagcttagtggttgatcctgattttgctaaagagatggttcagaggcaagctgcatggaggagagtggtgggtcttgctatatctgctgggattagcacaccaggaatgtgcgcaagtttagcgtatttcgacacttacaggcgtgctagattacctgcgaatctggttcaggcgcagagagatctctttggagctcatacatatgagagaaccgatcgtcctggtgcataccacactgaatggactaagcttgcaaggaagagtcagtaaagcatggacacagtcccttgatttgagggctttatttcatcatagaacacgaaaacaaattgtttcagcttatttttgttgagttataataagaaatgcaatgccccttgactctctgtatctgtctgttgatgatatctggagagtttcctttattttctcttatgtatggcttggttcatttttcgaatttgaatttgatatctatgttgaaattttggaagctgaagtcttcataattcttctgtagtcttcttgctcgttaaattgacgaatttttttccggtc

SEQ ID NO: 298 - protein, 487 aa, Arabidopsis thaliana
MESVALSRIGLAGLAVMGQNLALNIADKGFPISVYNRTTSKVDETLDRASNEGKLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 299 - DNA, 1714 bp, Brachypodium distachyon
  misc_feature (1664)..(1664): n is a, c, g, or t
ccacgcgtccgaggtggtggtcgcaattcgcatcgcacacgcagcacaactactctctctcagggcctccttcttcgtcgtcgtccacgcacgcagatctaaacgcagcagccaaggtaggagatggctctcacgagaattggtcttgctggccttgcggtcatggggcagaaccttgcccttaacattgcagagaaagggttccctatctctgtctacaacaggacaacttccaaggtcgatgagactgttcagcgcgccaagatagaaggaaaccttcctctgtatggtttccatgaccctgcatcctttgtgaactccattcagaagccacgtgtcgtcatcatgcttgtcaaggccggtgcaccagttgaccagaccattgcaacactcgcggcacacttggagcagggtgactgtatcattgatggaggaaacgagtggtacgagaacactgaaaggagggagaaggcgatggaggagcgtggactcctctatctcgggatgggtgtttctggaggagaggagggtgcccgccatggcccgtccatgatgcctggaggctcattggaggcataccagtacattgaagatattcttctcaaggtgtctgctcaagtccctgacagtggcccgtgcgtcacatacattgggaagggtggatcaggaaactttgtcaagatggttcacaatggaatcgagtatggagacatgcaactgatcgctgaggcatatgatgttcttaagtcggttggtaagctcacaaacagtgagctgcagcaggttttctccgagtggaacaagggtgagctcctcagtttcttggtcgagatcactgctgacatatttggcatcaaggatgaccaaggtgaaggctacttggtcgacaaggtcctggacaagactgggatgaaaggaacagggaaatggacagtccagcaggctgctgagctctctgtggctgctcctaccattgaggcttccttggattccaggttcctcagcgggttgaaggatgagcgggttgcggcctccaaaatcttccaaggtgactactccactgatctacctgtcgacaaggcacagttgattgaggatgtgaggaaagccctctatgcctcaaagatctgcagttacgctcagggcatgaacatcatcaaggccaagagcacggagaaaggatggggcctcaaccttggtgagctagccaggatttggaagggtgggtgcatcatccgcgccagcttcctggaccgcatcaagaaggcttatgacaggaacgctgagcttgccaaccttctcatagaccctgagtttgcgcaggagatcatggacagacaagctgcgtggcggagggttgtctgcctggctatcaacaatggtgtcagcaccccaggcatgtccgcgagtctggcgtactttgactcctaccggagggacaggctgcccgcgaacctggtgcaggcacagagggactactttggggctcacacctacgagagggttgacatgccaggctctttccacaccgagtggttcaagattgcaaactcgaagatctgagctgctgctgctccactgagtgacggcacggcaacatataaggcaatgtgtcatattttcagtatctctggttgccagttatgaatccttttttcctgtangggagaaactgctgttaatttttatttgagtaatgagtcttgtatttaaa

SEQ ID NO: 300 - protein, 479 aa, Brachypodium distachyon
MALTRIGLAGLAVMGQNLALNIAEKGFPISVYNRTTSKVDETVQRAKIEGNLPLYGFHDPASFVNSIQKPRVVIMLVKAGAPVDQTIATLAAHLEQGDCIIDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNSELQQVFSEWNKGELLSFLVEITADIFGIKDDQGEGYLVDKVLDKTGMKGTGKWTVQQAAELSVAAPTIEASLDSRFLSGLKDERVAASKIFQGDYSTDLPVDKAQLIEDVRKALYASKICSYAQGMNIIKAKSTEKGWGLNLGELARIWKGGCIIRASFLDRIKKAYDRNAELANLLIDPEFAQEIMDRQAAWRRVVCLAINNGVSTPGMSASLAYFDSYRRDRLPANLVQAQRDYFGAHTYERVDMPGSFHTEWFKIANSKI

SEQ ID NO: 301 - DNA, 1663 bp, Caenorhabditis elegans
agaaattaaaatggccgaagctgatattgccgtcatcggattggccgttatgggtcaaaatcttattctgaacatgaatgatcacggattcactgtttgcgccttcaacagaactgtcaaattggtcgacgattttcttgccaatgaagctaaaggaactaagattattggagctcattcaattgaggaaatgtgcaagaaattgaaaagaccacgtcgtgtcatgatgctcattaaagccggaactcctgtcgatatgatgatcgatgcaattgttccgcatcttgaggaaggtgatattatcattgatggaggaaattctgaatacactgattcaaacagacgctccgagcaactcgccgcaaaggggatcatgttcgtcggctgtggagtttccggaggagaagaaggagctcgttttggaccatctcttatgccaggaggtaatccaaaagcctggccacatctgaaagacatcttccaaaagatcgctgccaagtcaaacggagaaccatgctgtgattgggtaggaaacgctggatccggtcacttcgtgaaaatggttcataatggaattgaatatggagacatgcaactgatagctgaagcatatcatcttctgagcaaggccgtcgagctgaatcacgatcaaatggctgaagttcttgatgattggaataaaggagaattggaatctttccttattgaaatcaccgctaatattttgaaataccgtgacgagcaaggagagccaattgttccaaagattcgtgattctgctggacaaaagggaactggaaaatggacttgtttcgctgctcttgagtatggacttcctgttactcttatcggagaagccgttttcgccagatgtctatctgctctgaaggatgaacgtgttcgtgcttcgaaacaacttcctcgtccacaagtctcaccagataccgtcgttcaggacaaaagagtcttcatcaagcaaatcagcaaggctctttacgcctcaaaaatcgtcagttatgctcaaggatttatgcttcttgccgaagcatctaaacaattcaactggaatttgaactttggagctattgctttgatgtggagaggaggatgcattattcgttcaagattcctcggagacattgaacacgctttccaaaagaacaagcaactttccaatcttcttctcgatgatttcttcaccaaggccatcaccgaagcgcaggattcatggcgtgttgttgtgtgtgcagctgttcgtctcggaattccagttccagcattctcatcggccctcgctttctatgatggatacaccagtgaggtagttccggctaacttgcttcaagcccaaagagactatttcggagcccacacctacgagcttctcgccaagccaggtacatgggtacacaccaactggactggaactggtggacgtgtcacctcaaatgcttacaatgcataagcatagaaaaatatatacgttatattaacgtgattttatcataacttactactcgatattcaatcccccgttctaatttttctgtgattgattagtgtttactcgatttttttagttcccttctactactccactcttcctatttttcttcagtatttgattgccattcgtgtgaaataataaatgtgttctatggct

SEQ ID NO: 302 - protein, 484 aa, Caenorhabditis elegans
MAEADIAVIGLAVMGQNLILNMNDHGFTVCAFNRTVKLVDDFLANEAKGTKIIGAHSIEEMCKKLKRPRRVMMLIKAGTPVDMMIDAIVPHLEEGDIIIDGGNSEYTDSNRRSEQLAAKGIMFVGCGVSGGEEGARFGPSLMPGGNPKAWPHLKDIFQKIAAKSNGEPCCDWVGNAGSGHFVKMVHNGIEYGDMQLIAEAYHLLSKAVELNHDQMAEVLDDWNKGELESFLIEITANILKYRDEQGEPIVPKIRDSAGQKGTGKWTCFAALEYGLPVTLIGEAVFARCLSALKDERVRASKQLPRPQVSPDTVVQDKRVFIKQISKALYASKIVSYAQGFMLLAEASKQFNWNLNFGAIALMWRGGCIIRSRFLGDIEHAFQKNKQLSNLLLDDFFTKAITEAQDSWRVVVCAAVRLGIPVPAFSSALAFYDGYTSEVVPANLLQAQRDYFGAHTYELLAKPGTWVHTNWTGTGGRVTSNAYNA

SEQ ID NO: 303 - DNA, 2454 bp, Chlamydomonas reinhardtii
gcgtcttcatcactcttccaaccgcaccgttattcgaaggaggaaaggggaaaccccacttgttgattgaaaatgcaggcgcttcagcgtagcgccaagactctgccgaccaccagccagcgtgttcgtgagattgcagctgtcacttcggctcctcgtgctgtggctggccctctgtccgcgcgcacgactgcacctctcgtgcagccggtctcggcgccccttgcctccggccgtcgtgtggaggctcgcgcagcgtctactgcttccgctcccaagtcaagcaagggaaacgcaccgatggctgtcgctgaaatcggtctggttggcctggcggtcatgggccagaacttggccctgaacatcgcggagaagggctttcccatttcggtctacaaccgtagctatgacaagactgaggccgcggtgaagcgcgctcagaaggagggcctgggcgagaagctgcacggctacgagcaagtcaaggactttgtgcagagcctgcagaggccccggcgcgtcatcatcctggtgaaggccggcgcgcccgtggaccagaccattgaccaactgtgcgagttcatggagcctggtgacatcatcattgacggcggcaacgagtggtacgagaacacggagaagcgcatggccaaggttgccgccaagggcatcctgtacatgggcatgggcgtgtccggcggcgaggagggcgcccgcaggggtccctccatgatgcccggcggcagccctgaggcgtacagccacatcaagagtgtggtggagaaggtggcggcacaggtggacgacggcccctgcgtgatgtacattggtggcggcggcgcgggcaacttcgtcaagatggtgcacaacggcatcgagtacggcgacatgcagctcatcagcgaggcctacgacgtgctgaagacgctgggcggcctcaacaacgaggagctggcggcggtgttcaaggagtggaatgacgccgagctcaagtcattcctggtggagatcacggccatcattgtgaacaagaaggacgaccaggcgcccggatatctggtggaccagattgtggaccagaccggctccaagggcacaggcaagtggacggtgcagcaggcggctgagctggcggtggcggcgcccaccatggcctcggcactggacgcgcgctacatgagtgcgctcaagtcggagcgcgtggccgcctccaagtcgttcacaagctgtgtcacgcccggccctgttgcgggtgtggacaaggcgcagctgatcaacgacgtgcgcgcggcgctgtacgccagcaagatctgctcgtacgcgcagggcatgaacattatcaaggccaagagcgtggagatgaagtggaacgtcgacctgggcggcctggcgcgcatctggaagggtggctgcatcatccgcgcgcagttcctggaccgcatccgcgtcgcctacgagcgcaaccccgagctgccctcgctgctggtggaccccgacttcgccaaggagctcaccgctgccgaggcgtcctggcgccgcgtggccgcgctgtccatcacgcacggcgtgcccatcccctccatgacctcctccctgggctactttgacacctaccgccgcgagcgcctgcccgccaacctggtgcaggcgcagcgcgacttcttcggctcgcacacctaccagcgcttcgacaaggagggctggtaccacaccgtgtgggacgagaccttcggctccgccgactccatcaccaccagcggctacgtggtgtaaggcgaggcagcggggtggtgttgcgaagggcagagccactgctggtggcggcgtattgtcgtagcagacgtggcggtggtggttactggtcaaggcttacgcatctggacctgtcgcagggtcttgtgttgttatgcaaggtgaagaagagttgcgctggcgctgtgccgcttgtaccgtatgtgtttggtgctgttggaacggggccggcgtgattgcgcttgagcatttcaggcggccgccggctccaggagagcagtgtgatgtgcgtgctcgcgagggtcgtcggactgagaagggctatgggcggcatgcgtcgtgcccgatgccccagggtgtcggggcgcatgcaactggctgtagcgcttcaagccaggctggtcgacccctcacgtggctctcgagtggtttcggtagttcaactaccccgatgatgctattatcagttatgttccagggctcaattgggcgcctggtggtaccgtaccggtatgcatacattgtttctgggcagcggagaagtagtgcagttacggaggcaagtatttcttaggtcctaggaataactgcggggctgacccctatcgctcagtcccctgcgtgtttgtcccagcgcgtaatgcccaatgctcgaagatgagattgccacgaatatggctgtgtaaagctttgggactgcca

SEQ ID NO: 304 - protein, 566 aa, Chlamydomonas reinhardtii
MQALQRSAKTLPTTSQRVREIAAVTSAPRAVAGPLSARTTAPLVQPVSAPLASGRRVEARAASTASAPKSSKGNAPMAVAEIGLVGLAVMGQNLALNIAEKGFPISVYNRSYDKTEAAVKRAQKEGLGEKLHGYEQVKDFVQSLQRPRRVIILVKAGAPVDQTIDQLCEFMEPGDIIIDGGNEWYENTEKRMAKVAAKGILYMGMGVSGGEEGARRGPSMMPGGSPEAYSHIKSVVEKVAAQVDDGPCVMYIGGGGAGNFVKMVHNGIEYGDMQLISEAYDVLKTLGGLNNEELAAVFKEWNDAELKSFLVEITAIIVNKKDDQAPGYLVDQIVDQTGSKGTGKWTVQQAAELAVAAPTMASALDARYMSALKSERVAASKSFTSCVTPGPVAGVDKAQLINDVRAALYASKICSYAQGMNIIKAKSVEMKWNVDLGGLARIWKGGCIIRAQFLDRIRVAYERNPELPSLLVDPDFAKELTAAEASWRRVAALSITHGVPIPSMTSSLGYFDTYRRERLPANLVQAQRDFFGSHTYQRFDKEGWYHTVWDETFGSADSITTSGYVV

SEQ ID NO: 305 - DNA, 1843 bp, Citrus sinensis
cagtttcaatggaagcctctgctctctcacgcatcggtcttgctggcctagccgtcatgggccagaacctggccctaaacgtcgctgaaaaaggcttcccaatctccgtctacaaccgcactacttccaaagtcgacgaaaccctagatcgggcccaccgcgagggtcaactccctttgaccggccactacactcccagggacttcgtcctctccatccaacgccccagatccgtcatcatcttagtcaaagccggctcccccgttgaccagaccatcgccgccctctcggagcacatgtcccccggcgactgcatcatcgacggcggcaacgagtggtacctcaacaccgagcgccgtatccatgaagccagccagaagggtttgctttatctcggcatgggggtctccggcggcgaggaaggcgcgcgtcatggtccctctttgatgcccggtggctccttcgaggcttataataatattcgagatattttgcaaaaagttgccgcccaagttgatgatggcccttgtgttacttacattggtgaaggcgggtctggtaatttcgttaagatggttcataacggaattgaatacggagacatgcagttgatttccgaagcttacgatgttttgaagcacgtgggtggactcagcaatgccgagttagcggagatatttgatgagtggaataagggcgagttggagagtttcttggttgagatcactgctgatattttcaaggtgaaggatgaatatggtgagggtgagcttgttgataagattttggataagaccggaatgaaagggaccggcaaatggaccgttcagcaagctgctgagctctcagtcgctgccccaaccattgctgcgtcgttggattgtaggtacttgagcggcttgaaagaggaaagagagaaagccgccaaggtcttgaaagaggcgggattgaaagatgaggttcaaaatgtgggagtacatgttgacaagaagagattgattgatgatgtgaggcaagcgctgtatgcttccaagatttgtagttatgcgcaagggatgaatctgttgaggagtaagagtaatgagaaaggatggaatttgaattttggcgaattggcgaggatttggaaaggtgggtgtattattagagccgtttttttggataggattaagaaggcttatcagaggaatccaaatttagctagtttggtcgtggacccggagtttgcgagggagatggtgcagaggcaggctgcgtggaggagagttgtggggttggctatttcagctgggattagcactcctgggatgtgtgctagtctttcttattttgatacttacaggagggcaaggctgccagcgaatcttgttcaggctcagagagacttgtttggggcgcatacttatgagaggattgatcgccctgggtctttccacactgaatggacaaaacatgcccgccagactggtgccggtgttggtgcgttcaattgagctgctaccttttgttgcttgtttgtttgattgattgtttcaatcgggtattgatgatgttcaatttgaattagggttgtatctttcattgggaatttcatgcctagccattaaggcattgcaattatcaattagtctcacagtttagctgttaataagaaatggatgcctttctataggtacaaggttttctctcatgtgcaacactaaataatgcaatttcttttgctttttgttatgttattctttttcgttgtgtctcaaatgcaaatgcaaacatgtgcgcataaacttgctcatccagatcggaatgttcaataaaagttttctaacttcagctttgtgcgaag

SEQ ID NO: 306 - protein, 494 aa, Citrus sinensis
MEASALSRIGLAGLAVMGQNLALNVAEKGFPISVYNRTTSKVDETLDRAHREGQLPLTGHYTPRDFVLSIQRPRSVIILVKAGSPVDQTIAALSEHMSPGDCIIDGGNEWYLNTERRIHEASQKGLLYLGMGVSGGEEGARHGPSLMPGGSFEAYNNIRDILQKVAAQVDDGPCVTYIGEGGSGNFVKMVHNGIEYGDMQLISEAYDVLKHVGGLSNAELAEIFDEWNKGELESFLVEITADIFKVKDEYGEGELVDKILDKTGMKGTGKWTVQQAAELSVAAPTIAASLDCRYLSGLKEEREKAAKVLKEAGLKDEVQNVGVHVDKKRLIDDVRQALYASKICSYAQGMNLLRSKSNEKGWNLNFGELARIWKGGCIIRAVFLDRIKKAYQRNPNLASLVVDPEFAREMVQRQAAWRRVVGLAISAGISTPGMCASLSYFDTYRRARLPANLVQAQRDLFGAHTYERIDRPGSFHTEWTKHARQTGAGVGAFN

SEQ ID NO: 307 - DNA, 1895 bp, Drosophila melanogaster
agtagcagtactcattagagtccactcacaaaattagcaccaaccggcagtaattggtcaaggatcggcgatagcttcaaactccgaagttcaaagtcaaactgccgccctgcgaaagcttcgcgagtggagcttttctgcacttatcgatagctaacattgtggcgcgactatcgatcgacgagctgccgcttaacagtgccatatatagattgtaacattagaagctcaaatcattgttggagcacaaaccacaaagaacacacgaaacatgagcggacaagcggatattgccctcatcggcctggccgtcatgggccaaaacctgatactcaacatggacgagaagggattcgtggtgtgcgcctacaaccgcacggtggccaaggtcaaggagttcctcgccaatgaggctaaggacaccaaagtgattggagccgactcgctcgaggacatggtctccaagctgaagagcccccggaaggtcatgctgctggtcaaggctggaagtgcagtcgacgacttcatccagcagctggtgccgctgctttccgccggcgatgtgatcatcgatggtggcaactcggagtatcaggacacatctcgccgctgcgacgagttagccaaacttggcctgctcttcgtcggatccggcgtgagcggtggcgaggagggcgcccgccacggaccctcgctgatgcccggcggacacgaggccgcgtggccccttatccaacccatcttccaggcgatctgcgccaaggccgacggtgaaccctgctgcgagtgggtgggcgatggaggcgccggtcacttcgtcaagatggtgcacaacggcatcgaatacggtgacatgcagctgatctgcgaggcgtaccacatcatgcagagcctgggactgtcggctgaccagatggcagacgagttcggcaagtggaactcggccgaactggactccttcctcattgaaatcacgcgtgatattcttaagtacaaggacggcaaaggttatctgctggagcggattcgcgataccgccggccagaagggcacgggcaagtggacggcaatcgctgctctgcagtatggagtgcctgtgacgctaattggcgaggcggtcttctcgcgatgcctgtctgccctgaaggacgagcgcgtccaggccagcagcgtgctgaagggaccctcgaccaaggcgcaagtggccaacctcaccaagttcctcgacgacatcaagcacgctctctactgcgccaagatcgtgtcctacgcccagggattcatgctcatgcgagaggcggccagggagaacaagtggagacttaattacggcggcattgcgctgatgtggcgcggcggctgcatcatccgcagcgtctttctgggcaacattaaggacgcgtatacgtcgcagccggagctgtctaatctgctgctggacgacttcttcaagaaggccatcgagcgcggccaggactcgtggcgcgaggtggtggccaatgccttccgctggggcattcccgtgccggccctgtctaccgccctaagcttctacgacggctaccgcacggccaagctgccagccaacttgctgcaggcccagagggattacttcggcgcccacacctatgagctgctgggccaggagggtcagttccaccacacgaactggacaggcaccggcggcaatgtgtccgccagcacctaccaggcgtaggttccacctgctccactttcccgttcacacattccatgtcattggcgccggtgtcttagatgtttcttttttttctggagtactttagtacttatttataccattaatatatatgtatgtatatagaatttcataattgttgttaaacataacattaaattggtgtttttttgctagc

SEQ ID NO: 308 - protein, 481 aa, Drosophila melanogaster
MSGQADIALIGLAVMGQNLILNMDEKGFVVCAYNRTVAKVKEFLANEAKDTKVIGADSLEDMVSKLKSPRKVMLLVKAGSAVDDFIQQLVPLLSAGDVIIDGGNSEYQDTSRRCDELAKLGLLFVGSGVSGGEEGARHGPSLMPGGHEAAWPLIQPIFQAICAKADGEPCCEWVGDGGAGHFVKMVHNGIEYGDMQLICEAYHIMQSLGLSADQMADEFGKWNSAELDSFLIEITRDILKYKDGKGYLLERIRDTAGQKGTGKWTAIAALQYGVPVTLIGEAVFSRCLSALKDERVQASSVLKGPSTKAQVANLTKFLDDIKHALYCAKIVSYAQGFMLMREAARENKWRLNYGGIALMWRGGCIIRSVFLGNIKDAYTSQPELSNLLLDDFFKKAIERGQDSWREVVANAFRWGIPVPALSTALSFYDGYRTAKLPANLLQAQRDYFGAHTYELLGQEGQFHHTNWTGTGGNVSASTYQA

SEQ ID NO: 309 - DNA, 1878 bp, Danio rerio
ttcagcagagaccgaataacagcagtcaaaaccctcatcgaaactctcatttttgaacggaaccaaacttcaacaatggctcaagcagatattgctctcattggtctggctgtgatgggtcagaatctgatcctgaacatgaatgaccatggatttgtggtctgtgcattcaacagaaccgtctccaaagtccatgacttcttaaacaatgaagccaaaggcactaaggtgatcggggccgaatcgcttgaagacatggtgtcaaaactcaaaaaacctcgccgcatcatcctgctggtcaaggcaggacaggctgttgatgacttcatcgataaactggttcctcttcttgagcctggagacatcatcattgatggtggaaattcagagtacagagatacaacgagacgttgtaagagcctgaaggagaagaatcttctgtttgtgggtagtggagtaagtggaggagaagatggggcacgttacggaccctcgctgatgcccggaggacataaagatgcctggccacacttaaaagacatttttcagagcattgctgccaaagtgggcaccggagagccgtgctgcgactgggttggagatgaaggagcgggtcattttgttaaaatggtccacaacggtattgaatacggggacatgcagctgatctgtgaggcctatcatctgatgaaggacgtgctttgtatgaaccatgatgaaatggctcaggtcttcgaacagtggaataagacagagctggactccttcctcatcgagatcacagccaacatcctaaaattcaaggacgcagacggcactaacctgctgcccaaaattagagacagcgccgggcagaagggcacagggaaatggacggctatctctgctctggaatacggcacacctgtcacactgatcggggaagctgtctttgccagatgcctctcgtctctgaaggatgaaagagttcaggccagtaagagcctcagcggccctcagggtgtcaagttcactggaaacaaagaacagttccttgaagacattagaaaggccttgtatgcctctaagatcatttcgtatgctcaaggcttcatgctgctgcgtcaggctgcgctggagttcggctggtctctgaattatggtgctattgctctgatgtggagaggaggctgcatcatccgcagtgttttcttgggaaagatcaaggaagcgtttgaccggaacccagagctgcagagtttgttgctggacagcttcttcagtaaggctgtacaggattgtcaggactcgtggcgtagggttgtgagtacaggtgtgcagcagggaatccccatgcccagtttcaccaccgcactgtccttctatgacgggtacagacacgagatgctcccagcaaacctgctgcaggcacagagagactactttggtgcgcacacgtatgagctgctatcaaaccctgggactttcatccacactaactggacaggacacggtgggaaagtgtcatcttcatcctataatgcctaaaatcaagaagccaccattggtaaaacagcagacaacatcccctcttgatgaaggaccagagcagctgatcacattcctgcagaagagctggagttcttactgaatgagtgttcaaacacacatttctatttatactagatcatagtatacacactatttgtacactttcgttcttgtagttttaaggtgcactgttgcaaacacactatcttcgagtgtgtgagatttttcctgctgtaaaccagtcatactttgcccccggagttcacagcgttaaccctggattacggtgactattgcactgcattaggctaaataaagatttcaatccctaaaaaaaaaaaaaaaaaa

SEQ ID NO: 310 - protein, 483 aa, Danio rerio
MAQADIALIGLAVMGQNLILNMNDHGFVVCAFNRTVSKVHDFLNNEAKGTKVIGAESLEDMVSKLKKPRRIILLVKAGQAVDDFIDKLVPLLEPGDIIIDGGNSEYRDTTRRCKSLKEKNLLFVGSGVSGGEDGARYGPSLMPGGHKDAWPHLKDIFQSIAAKVGTGEPCCDWVGDEGAGHFVKMVHNGIEYGDMQLICEAYHLMKDVLCMNHDEMAQVFEQWNKTELDSFLIEITANILKFKDADGTNLLPKIRDSAGQKGTGKWTAISALEYGTPVTLIGEAVFARCLSSLKDERVQASKSLSGPQGVKFTGNKEQFLEDIRKALYASKIISYAQGFMLLRQAALEFGWSLNYGAIALMWRGGCIIRSVFLGKIKEAFDRNPELQSLLLDSFFSKAVQDCQDSWRRVVSTGVQQGIPMPSFTTALSFYDGYRHEMLPANLLQAQRDYFGAHTYELLSNPGTFIHTNWTGHGGKVSSSSYNA

SEQ ID NO: 311 - DNA, 1407 bp, Escherichia coli
atgtccaagcaacagatcggcgtcatcggtatggctgtgatggggcgcaacttggctctaaacatcgagagccgtggttataccgtatccgtctataatcgctcgcgtgaaaaaactgaagaggttgttgccgaaaacccaggtaagaaactggtcccttattacacggttaaagagttcgtcgagtctcttgaaactccacgccgtatcctgttaatggtcaaagcgggtgctggcactgatgctgcgattaattccctgaagccctatctagataaaggcgacatcatcattgatggcggtaataccttctttcaggacacaattcgtcgtaaccgtgaactttccgcggaaggctttaactttatcggggccggggtttcaggtggtgaagagggcgcgctgaaaggcccatctatcatgcctggtggccagaaagatgcgtatgaaatggttgtgccaatcctgaccaagattgccgcgatagctgaagatggtgaaccgtgcgtgacgtatattggtgcggatggtgcaggtcattacgtgaagatggtgcacaacggtatcgaatatggcgatatgcaattgatagctgaagcctattctctgctgaaaggtgccctaaatctgtctaatgaagagttagcctctatctttaatgaatggaatgaaggcgagctgagcagctatctgattgacatcactaaggatatcttcaacaaaaaagatgaagagggtaaatacttggttgatgtgattttggacgaagctgcgaacaaaggtacaggcaaatggaccagccagagctctcttgatctaggcgaaccgctgtcgttgatcaccgaatccgtatttgcccgctacatctcctctctgaaagaccagcgtgttgcggcctctaaagtgctgtctggcccgcaggctaaactggctagtgataaagctgagtttgttgagaaagtacgccgtgccttgtacctaggcaaaattgtctcttatgcccaaggcttttctcaacttcgtgccgcatcagagcaatacaactgggatttgaactacggtgaaatcgcgaaaattttccgcgcaggctgcattattcgtgcacagttcctccagaaaatcaccgacgcttatgctgaaaacaaagatattgcaaacctgctgcttgctccgtatttcaaacatatcgctgatgaatatcaacaagccctccgtgatgtagtgtcttatgctgtgcagaacggtattccggtaccgactttctccgccgctgtagcttactacgacagctaccgttctgcggttctgccggctaacttgatccaagcacagcgtgattatttcggtgcgcacacgtataaacgcattgataaagaaggtgtttttcatacagaatggctagaataa

SEQ ID NO: 312 - protein, 468 aa, Escherichia coli
MSKQQIGVIGMAVMGRNLALNIESRGYTVSVYNRSREKTEEVVAENPGKKLVPYYTVKEFVESLETPRRILLMVKAGAGTDAAINSLKPYLDKGDIIIDGGNTFFQDTIRRNRELSAEGFNFIGAGVSGGEEGALKGPSIMPGGQKDAYEMVVPILTKIAAIAEDGEPCVTYIGADGAGHYVKMVHNGIEYGDMQLIAEAYSLLKGALNLSNEELASIFNEWNEGELSSYLIDITKDIFNKKDEEGKYLVDVILDEAANKGTGKWTSQSSLDLGEPLSLITESVFARYISSLKDQRVAASKVLSGPQAKLASDKAEFVEKVRRALYLGKIVSYAQGFSQLRAASEQYNWDLNYGEIAKIFRAGCIIRAQFLQKITDAYAENKDIANLLLAPYFKHIADEYQQALRDVVSYAVQNGIPVPTFSAAVAYYDSYRSAVLPANLIQAQRDYFGAHTYKRIDKEGVFHTEWLE

SEQ ID NO: 313 - DNA, 1805 bp, Euglena gracilis
gcacgaggattttttttcgcctttcctctttgtgacgatgtcgtgcgacgttggtctgtatggcctggcggtgatggggcagaacttcgcccttaacatggccgagcacggctttaccgttgccgtctgcaaccgctcaccgggcaaggtggacgacacggtggagcgggccaagggggagggcaacctgcccctcctcggcttcaaggacccgaaggacttcgtccaggcgctgaagcggccccgccgcatcgtcatcctggtgcaggccggcaagccggtggacgacaccatcgcgcacctcagcgggttcctggaggccggcgacctcattgtggacggcggcaacgagtggttccccaacagccagcggcgcgcggagctgctacgcccaaagggcatcctgttcatggggatgggcatctccggcggggaggagggcgcccgcaaggggccgtcgctgatgcccggcggggagcccggggcctacgagctgatggagcccatcatcacgaagtgcgccgcccaggtggacgacggcccgtgcaccttcaacattgggccggtgggcagcgggaactacgtgaagatggtgcacaatggtattgagtacggcgatatgcagatgattgcggagacctatgacctgctgaagcagcttgggggcttgacgaatgccgagctggcgaccaccttcacctcttggaacgagaccgagctcgccagctttttgatcgagatcacggggatcatcttcacgaaggcggacgaccagggggccccgggggagctggtggactacatcctggacaagacagggatgaagggcaccggccgctggaccatccaggaggctgcggagcgcaactccccggcctgcgtcatggccgccgccctcgacgcccgctacatttccgcccgcaaggacgagcgcgttgccgcggaggccatcctgaagggccccacggaccccacgccggcggtggacaaggcggcgttcgtggcggacgtgcgggcggcgctgttctgctccaaggtggtgagctacgcgcaggggatgaacctcatccgcagcgccgggcaggagctcggctggcccatcgacctcgcggagtgcgcgcggatctggaagggcggctgcatcatccgtgccgcattcctggacgacatcaagaaggcgttccagcagaacccagcactgcccaacctgctggtggacccctacttctccagcatgctgaacagccgcaccgccgcgtggcgccgggtggttcaactggccgtggtcagtggtatcgctgctccagccatatcggctgctttggcatatttcgactcctatcgccggggctccctccccgccaacctgacgcaggcccagcgggacttcttcggaggccactcctaccagcgtacggatagggatggcgtcttccattgcgagtggacgagtgcccacaaggcaattggaaacattgcggagagaactcgtggcaacctgtgaccacactggtcctgagcctcgaaacccagcgggttccctcactgttctccgggattttgacacgcaggtggcagagatgcgcgggcccttcgtcgtggggcaatgcgtcggccagtgtggtggcccaccgccctccccgttgcctattctcgctctgtggtccatcgccgtcctcccgtcatgtcgtttctttgcccaaaaaaaaccttcgaagcgctgccgtcccaggtgtccgtctttcgacgctccttgtgaaagcacgtgcagcaatgtttgcgttttcaaaaaaaaaaaaaaaaaa

SEQ ID NO: 314 - protein, 488 aa, Euglena gracilis
MSCDVGLYGLAVMGQNFALNMAEHGFTVAVCNRSPGKVDDTVERAKGEGNLPLLGFKDPKDFVQALKRPRRIVILVQAGKPVDDTIAHLSGFLEAGDLIVDGGNEWFPNSQRRAELLRPKGILFMGMGISGGEEGARKGPSLMPGGEPGAYELMEPIITKCAAQVDDGPCTFNIGPVGSGNYVKMVHNGIEYGDMQMIAETYDLLKQLGGLTNAELATTFTSWNETELASFLIEITGIIFTKADDQGAPGELVDYILDKTGMKGTGRWTIQEAAERNSPACVMAAALDARYISARKDERVAAEAILKGPTDPTPAVDKAAFVADVRAALFCSKVVSYAQGMNLIRSAGQELGWPIDLAECARIWKGGCIIRAAFLDDIKKAFQQNPALPNLLVDPYFSSMLNSRTAAWRRVVQLAVVSGIAAPAISAALAYFDSYRRGSLPANLTQAQRDFFGGHSYQRTDRDGVFHCEWTSAHKAIGNIAERTRGNL

SEQ ID NO: 315 - DNA, 1906 bp, Glycine max
tgattccagaccttaatttttctctcattcgcttcaaatttcaggaaatcaattatggctcaaccctcaacaagaataggccttgctggactggctgttatgggccaaaatctagcactcaatattgctgagaaaggctttcccatttctgtttataaccgaaccacttccaaggttgatgagactgtagaacgagcaaaacaagaaggaaatcttccagtttatggctaccatgaccccgaagcttttgttcattccattcaaaagcctagggtgataataatgcttgttaaggctggggcacctgttgaccagaccattaagaccctatctgcatacatggaaaaaggtgactgcataattgatggtggtaacgaatggtacgagaacaccgaaagaagagagaaagaggtggctgaattgggtctgctctaccttgggatgggagtttctggtggtgaggaaggtgctcgtaatggtccctctttgatgcctggtggttcgtttgaggctttcaaatacatagaagatattcttctcaaggtggcagctcaagtacctgacagtggtccttgcgtgacttatattggtaaaggtggttctggtaattttgtgaagatgatccacaatggcattgagtatggtgacatgcagctgattgcagaggcctatgatgtgctgaaatcagttggaaagttgtcaaatgaggaactacaaagtgtcttctcagaatggaacaagggagaacttctgagtttcctgattgaaatcactgcagatatatttggaattaaggatgataagggagatggatatcttgttgacaaggtcctagacaagactggcatgaagggcactggtaagtggactgttcagcaagctgctgaattatcaattgctgctcccactattgaagcatcattggatgcaaggttcctgagtgggttgaaggaggaaagagttgaagctgcaaaggtctttaaatcaggtggcattggtgatatcgtgactgatcaacctgtagacaagaaaaaattggttgatgatgttaggaaggctctttatgcagccaaaatctgtagttatgcacagggaatgaatttgatccgtgcaaagagtattgaaaagggttgggatttgaagttgggtgaactggcccggatttggaaagggggttgcattattagagcaatattcttagacagaatcaagcaggcatatgaaagaaaccctaatctggcaaaccttcttgtggatccagagtttgcaaaggaaataattgattaccaatctgcctggaggagagttgtttgccttgctatcaattctggtattagcactccaggtatgtctgctagtcttgcttattttgacacttacagaagggaaaggttgccagctaatttggtgcaagctcaacgagactactttggtgctcatacatatgaaagggttgacatagaggggtcttaccatactgagtggttcaagcttgccaaacagtcaagaaattagattactgtatttgagccaatcaggattttcctaataaatgtaatattttctgctcagactgtatgctgagttgagtttgcatatccacaatgtggtgaagttttattatattatttccaactgaattgcttggcagtttgttttccaacaactatgttgtatctttgctgatcatgcttggtgcttgatacaaaattcccagttcatggtgcctttttaattttcacatttttataagatttcctttagcaccatggatacatgttatgttacagcaggagttgaaatttttagttttatctttaacttgttgagtttaatgttgatctactgtcaagagtgaataagttcgatattgttggacaatattaagaatatcagtagatattgt

SEQ ID NO: 316 - protein, 486 aa, Glycine max
MAQPSTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGMGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQPVDKKKLVDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQSRN

SEQ ID NO: 317 - DNA, 1819 bp, Gossypium raimondii
cgaaagggagaaacatggctccacctaccttgatagggcttgctggtttggctgttatgggccaaaatcttgcacttaacattgctgagaaaggctttcccatttctgtttataacagaactacctctaaagtcgatgagactgttgaaagagctaaaaaggagggagatcttcctgtatatggtttccatgatcctgaatcttttgttcagtcaatccagaaacctagagtggtaatcatgcttgttaaggcaggggcccctgttgaccaaaccattaagactctctctgcatacttggagaaaggtgattgtatcatcgatggtggcaacgagtggtatgaaaacactgagagacgacagaaagagatgtcggcactgggtttgttataccttgggatgggagtttcaggtggagaagaaggtgcacgaaatggtccctctttaatgcctggagggtcctttgaagcttacaaatacattgaagacattcttcttaaagttgccgctcaagttccagatagtggcccatgtgtgacttacattggaaaaggtggatctggtaattttgtcaagatggttcacaatggaattgaatatggtgatatgcaactgattgcagaggcttatgacgtgctgaaatctgttgggaaattatctaatgaagaactacatagtgttttctcagaatggaacaagggggagcttttgagcttcttgattgaaatcactgctgatatatttggaattaaggatgacaaggcagatggttatttagttgataaggttttggacaaaactggcatgaagggtactggtaaatggactgtacagcaagctgctgatttgtccattgcagctccaacaattgcagcttctctggattcaaggttccttagtgggttgaaagaggaaagagttgaagctgctaaagtcttcaaatcaggaggatttggtgatgtcttgaccgaccaagttgtggacaaggcaagattaattgatgatgtaaggcaagcactttatgcatccaagatttgcagttatgctcagggcatgaatctcattcgtgcaaaaagcatcgagaagggttgggacttgaagttgggggaactggctaggatatggaagggaggctgcattatccgcgctattttcctggacagaatcaagaaggcttatgatagaaattctgaccttgcaaaccttcttgtcgacccagaatttgcaaaggaaatcattgacaggcaatctgcttggagaagagttgtttgtcttgctatcaactctggtattagcactccaggcatgtcagccagtcttgcctatttcgacacttataggagggaacgagtaccggctaatttggttcaagctcaacgagattattttggtgcccatacttatgaaagggttgacatggacggatctttccacactgaatggttcaagatcgccaaaaagctaaaagattaatattattctagcagtactcttcagaacactcccaataagtgtaataaaatctgctctggactctatgctacacagagctacaactatgattatctttttcaaaatttatctcaacttcatttctcaaattgagctgcgaatttataccctgttctaggattaatgtgcttttatgttttttccggatttgagtatttacccaatgtgggtcactgtggttaattactgtgtgaagtgtgaactgtaagagaaagtcaactttttttcctttttgcttgataatcttctgttccttttaattttcttgttttcttgtactgttagatatcaacatcttttcgacaggt

SEQ ID NO: 318 - protein, 485 aa, Gossypium raimondii
MAPPTLIGLAGLAVMGQNLALNIAEKGFPISVYNRTTSKVDETVERAKKEGDLPVYGFHDPESFVQSIQKPRVVIMLVKAGAPVDQTIKTLSAYLEKGDCIIDGGNEWYENTERRQKEMSALGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLSNEELHSVFSEWNKGELLSFLIEITADIFGIKDDKADGYLVDKVLDKTGMKGTGKWTVQQAADLSIAAPTIAASLDSRFLSGLKEERVEAAKVFKSGGFGDVLTDQVVDKARLIDDVRQALYASKICSYAQGMNLIRAKSIEKGWDLKLGELARIWKGGCIIRAIFLDRIKKAYDRNSDLANLLVDPEFAKEIIDRQSAWRRVVCLAINSGISTPGMSASLAYFDTYRRERVPANLVQAQRDYFGAHTYERVDMDGSFHTEWFKIAKKLKD

SEQ ID NO: 319 - DNA, 1941 bp, Hordeum vulgare
gcacttgtccccttcctcccttccttccttccttgttcctcccttcgcgcaggcagatcccatccttcctccctcccttccttcgcgcaggcagatcccatccaaggcaggcaggcaggcaggcaggtacgggatggctctcaccagaattggtcttgccggcctcgccgtcatggggcagaaccttgccctcaacattgcagagaaaggcttccccatctctgtctacaacaggacgacatccaaggtcgacgagaccgtccagcgcgccaagctagaaggaaaccttcctctctacggtttccatgaccctgcatccttcgtcaactccattcagaagccacgtgtcgtcatcatgcttgtcaaggccggtgctccggttgaccagaccatcgccacgctcgcagcacacctggagcagggcgactgcatcgttgacggaggaaacgagtggtatgagaacacagaaaggagggagaaggcgatggaggagcgtggactcctctacctcggtatgggtgtttctggaggagaggagggtgcccgccatggcccgtccatgatgcctggaggctcgttggaggcgtaccagtacattgaagacattcttctcaaggtgtctgctcaggtccctgacagcggcccgtgcgtcacatacattgggaagggcggctctggaaactttgtgaagatggttcacaatggtattgagtacggtgacatgcagctgatcgctgaggcgtatgacgtcctcaagtcggttggtaagctcacaaacggtgagctgcagcaggttttcgccgagtggaacaagggtgagctcctcagtttcttggtcgagatcacagctgatatattcagcatcaaggatgaccagggtgaaggttacttggtcgacaaggtcctggacaagacagggatgaagggaaccgggaagtggacggtgcagcaggccgctgagctctccgtggctgctcctaccattgaggcgtccttggattccaggttcctcagcgggctgaaggacgagagggtggctgcttccaagatcttccagggtgactacagcagcggcgaaactgtcgacaaggcacagctgattgaggatgtgaggaaggccctgtacgcctccaagatctgcagctacgcccagggcatgaacatcatcaaggccaagagcacggagaaggggtggggcctcaacctcggcgagctggccaggatctggaagggcgggtgcatcatccgtgccagcttcctcgaccgcatcaagaaggcctacgacaggaacggtgagctcgccaacctcctcatcgaccccgagttcgcgcaggagatcatggacaggcaagccgcgtggaggagggtcgtctgcctcgccatcaacaacggcgtcagcacccccggcatgtccgcgagtctggcctacttcgactcctaccggagggacaggcttcctgccaacctcgtccaggcccagagggactacttcggggcgcacacctacgagagggtcgacatgcccggctccttccacaccgagtggtacaagatcgccaactcgaagatctaagctgctgctgccgctggtctaccgagagacggcccgtcaggtttcgtcttgttggtatcctttgccgctgccagtcatgagtccttttcctgcaggggagcaactgccgtttaatttttactattcgagtataatgagtcctgtatttattttctacaaggagatcacatattctctccagtccctccactacttccatgtgattgatcaaaccctggagggaagacagtaattgttgctcgtcgaatctcccccggcgattattctgaattagtttgaataaaatgtgttttcacctacccgtctttttttacccgtgtttgatttgatttgatgggcaatgatccttctttcccaagaccgctttt

SEQ ID NO: 320 - protein, 479 aa, Hordeum vulgare
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 321 - DNA, 1593 bp, Laminaria digitata
atgtccgcttccgcgctgtccgacgttggcctctatggcttggcggtcatgggacagaacttcgcgctcaacatggcgagccacggcttctccgtgtctgtgagcaaccggtcgcccgagaaggttgacgctaccgttgcgcgcgccaaggaggagggcaacctccccttgaggggcttcaaggaccccaagagcttcgtggactccctctcgaaacctcgcaagatcgtcctgctcgttcaggccggcgccgccgtagacgccaccatcgccacgctttccgagctcttggaggaaggagacatcctcgtcgacggtggcaacgagtggttccccaactcgcagcgccgcgcgaaggagctggagccgaagaagatcatgttcgtcggcatgggtgtctccggcggagaggaaggcgcgcgcaacggcccctcgcttatgcccggtgggcctagggaggcgtacgacgcgctttcgcccatcatttcgaagtgtgctgctcaggtcgacggaccgtgcacaacttacctgggcagcatcggctcaggaaactacgtgaagatggtccacaacggcatcgagtacggagacatgcagctcattgccgaggtgtacgacgtactcaagcacgtggctggcttgaccaacgacgagctttcggctacgttcacggactggaaccagggagagctccagagctttttgatcgagatcacggccgtgattttttcgaggaaggacgacctcacgtccagcggccacgtcgtagacaagatcctcgacaagacaggcatgaagggcactgggcgatggacggtccaggaagccgccgaacgcagcaccgccgcgcctaccatggccgccgcactcgatgcccgctacatgagcggccgcaagggcgagcgtgttgaagctgccaagactctcaagggacccagcacgatcccccaggtgcctaaggcgcagctgatcgaggacatgaaggccgccctttactgctccaagatctgctcatacgcacagggcatgaacctcatcaaggccgcatccgagcacttcgagtggggcgtggacctcggagagtgtgcccgtatctggaagggcggctgcatcatccgggctgcgttccttgacgacatcaagaacgcctatatcaagaacgccgacctcgacaaccttcttgtcgaccccttcatcacctctcagatcttggagcgccaggcggcctggaggcgtgtggtgaccctctgcgtggcaagcggcatcgctgcccctgccatgaccgcgtctctgtcctacttcgactcctaccgccgcgctcgcttgccagccaaccttgttcaggctcagcgcgacttcttcggagcgcacacgtacgagcgcgtggacaaggagggagtcttccactgcctctgggacgacacccacaaggaaatcgcgacatcgccggcgcatggcgggcgaactctaataggatcgctcccaaacttgttccgtcctttgtgtatggggtgtctaaattggagcagcacggtcgtgtctgtagcatactgcggtatgaagtattacatagggagcctgagttttacgtag

SEQ ID NO: 322 - protein, 530 aa, Laminaria digitata
MSASALSDVGLYGLAVMGQNFALNMASHGFSVSVSNRSPEKVDATVARAKEEGNLPLRGFKDPKSFVDSLSKPRKIVLLVQAGAAVDATIATLSELLEEGDILVDGGNEWFPNSQRRAKELEPKKIMFVGMGVSGGEEGARNGPSLMPGGPREAYDALSPIISKCAAQVDGPCTTYLGSIGSGNYVKMVHNGIEYGDMQLIAEVYDVLKHVAGLTNDELSATFTDWNQGELQSFLIEITAVIFSRKDDLTSSGHVVDKILDKTGMKGTGRWTVQEAAERSTAAPTMAAALDARYMSGRKGERVEAAKTLKGPSTIPQVPKAQLIEDMKAALYCSKICSYAQGMNLIKAASEHFEWGVDLGECARIWKGGCIIRAAFLDDIKNAYIKNADLDNLLVDPFITSQILERQAAWRRVVTLCVASGIAAPAMTASLSYFDSYRRARLPANLVQAQRDFFGAHTYERVDKEGVFHCLWDDTHKEIATSPAHGGRTLIGSLPNLFRPLCMGCLNWSSTVVSVAYCGMKYYIGSLSFT

SEQ ID NO: 323 - DNA, 1890 bp, Malus domestica
cccagatctttgatttcttgggttcgctcgatttcctcagattttcaatcccccttctctccttacagaagaacactttcagtttcaggcaaaaagatggctgcaacaccaaaacctacaagaataggccttgccggtttggctgtcatgggccaaaatttggctctcaacattgcagagaaaggcttccccatttcggtatacaatagaactacctccaaagttgatgagaccgttgagcgagctaaaaaggaaggaaaccttcccctttatggattccatgatcccgaatcttttgttaagtcaatccagaaaccccgtgtcgtgatcatgcttgtcaaggctggggcgcccgttgaccagaccataaagaccctctccgtctacctggagaaaggtgactgcatcattgatggtggtaatgagtggtatgagaatactgagaggagggagaaagccatggctgaactaggtcttctttaccttggaatgggagtttcaggtggtgaggagggcgctcgatacgggccttctatgatgcctggaggttcctttgaggcctataagtacattgaagacattcttcttaaggtgtcagctcaagttccggacagtggtccttgtgtgacttacattggcaaaggtgggtctggtaactttgtcaagatgattcataatgggattgaatacggcgatatgcagctgatagcggaggcttatgatgtactgaaatcagtaggaaagttgtcaaatgaggaactccaaaaagctttctcagagtggaacaaaggtgaacttctcagtttcctgattgaaatcactgctgatatatttggaatcaacgatgacaagggagatggatatttggtcgacaaggttttggacaagactggcatgaagggtactggtaaatggaccgtacagcaagctgctgaactatcagttgctgctccaacaattgaatcttcattggatgcaaggttcctcagtgggttaaaggacgagagggttaaagcagctaaagtgttcaaatcagccggctttgaggatagcttgaacaccccagaggtggataaggcaaagctgatcgatgatgtgaggcaagcactttatgcatcaaagatatgcagttatgcacaagggatgaatttgatccgtgcaaagagtattgagcagggatgggacttgaagttgggcgaattggccaggatctggaagggaggttgcatcattcgtgcggtgttcctagacagaattaagaaggcatatgacaggaatgctgatcttgcaaaccttcttgtggacccagagttctcgaaagagatcgttgagaggcagtctgcctggagaagggtggtatgccttgctatcaactcaggcatcagcacccctggtatgtcagctagtcttgcttatttcgactcctacagaagggaaagcctgcccgctaacttggtccaagctcagcgtgactacttcggtgctcacacatacgaaagaactgacatggaaggtgctttccatactgaatggttcaaaatcgcgaaacagtcaaagatttaagtccaatttctgtggcacattcaactcaagcagagaacactccatctgaataatttctgctgacgattttacgctgggcggagcttctgccaactctttttcagtgaaaaaatttatcccaaataagttttatcagtttattttttaagactttgaagggtgctttgttatgctcgtgcttttggcagatctgtccacgcccacaacccctttctaactttgaaagatgtaattctattcaattcaggggaactcaaaatttttatatttatctcaatttcagcagctctaattagatatttttgtgcatttttcttgcaaaaaaaa

SEQ ID NO: 324 - protein, 488 aa, Malus domestica
MAATPKPTRIGLAGLAVMGQNLALNIAEKGFPISVYNRTTSKVDETVERAKKEGNLPLYGFHDPESFVKSIQKPRVVIMLVKAGAPVDQTIKTLSVYLEKGDCIIDGGNEWYENTERREKAMAELGLLYLGMGVSGGEEGARYGPSMMPGGSFEAYKYIEDILLKVSAQVPDSGPCVTYIGKGGSGNFVKMIHNGIEYGDMQLIAEAYDVLKSVGKLSNEELQKAFSEWNKGELLSFLIEITADIFGINDDKGDGYLVDKVLDKTGMKGTGKWTVQQAAELSVAAPTIESSLDARFLSGLKDERVKAAKVFKSAGFEDSLNTPEVDKAKLIDDVRQALYASKICSYAQGMNLIRAKSIEQGWDLKLGELARIWKGGCIIRAVFLDRIKKAYDRNADLANLLVDPEFSKEIVERQSAWRRVVCLAINSGISTPGMSASLAYFDSYRRESLPANLVQAQRDYFGAHTYERTDMEGAFHTEWFKIAKQSKI

SEQ ID NO: 325 - DNA, 1601 bp, Medicago sativa
tacattatggctccaccacttacaagaataggccttgccggattggctgttatgggccagaatctcgcactcaatattgccgacaaaggattcccaatttctgtttataatagaacaacatcaaaggttgacgaaactgtggaacgagcaaaacaggagggaaatcttccactctatggcttccatgaccctgaagcctttgttaattccattgaaaaaccaagggtgattataatgcttgttaaggctggtgcacctgttgaacagaccaccaaaaccctatctgcgtaccttgaaaaaggtgattgtataattgatggtgataatgaatggtacgagaacactgagagacgagagaaagaggtagccgaattgggtattctctaccttggaatgggagtttcaggtggtgaggagggtgctcgacgtggtccttctatgatgcctggtggttcgtttgaagcttacaaatacatagaagatattcttctcaaggtggctgctcaagttcctgacagtggcccttgtgtgacatatatcggtaacggtggatctggtaattttgtgaagatgatccataatggaattgaatacggtgacatgcagctgattgctgaggcttacgatgtgttgaagtcagttggaaagttgacaaatgaggagctacaaagtgcatttactgaatggaacaagggagaacttttgagtttcctgattgaaatcactgcagatattttcggaattaaggatgataagggtgatggatatcttgttgacaaggttcttgacaaaactggcatgaagggtaccggtaagtggactgttcagcaagcagctgaattatcagttcctgctcccaccattgaagcttcattggatgctaggttccttagtgggttgatggatgaaagagttgaagctgcaaaggtctttaaatcaggtggttttggcgatatcttgaccgaccaacaagtagacaagaagcagttgattgatgatgttaggaaggctctttatgcagccaagatttgtagttacgcacaagggatgaatctgatccgtgcaaagagtgctgaaaagggttgggatttggcattgggtgaacttgcccgtatttggaaaggaggttgcatcattagagctatattcttggacagaatcaagcaagcgtacgacagaaaccctaatctcgcaaaccttcttgtggatccagagttcgcaaaggaaataattgaacgccaaaccgcatggaggagagttgtttccctttctgtcaattcaggtatcagcctcccaggtatgtctgctagtcttgcatattttgacagttatagaagggaaaggttaccggctaatttggtgcaagctcaacgagactacttcggtgctcatacatatgaaagggttgatattgaggggtcgtaccatactgaatggttcaagcttgccaagcagtcaaggatttagattactgtatttgaactcttcaagattcctaataaatgtaatgttttttactcaagactgtatgctgagttgagcttacatagctgcaatgcggtgaagtttatttataccattctgtactacttaattacttg

SEQ ID NO: 326 - protein, 486 aa, Medicago sativa
MAPPLTRIGLAGLAVMGQNLALNIADKGFPISVYNRTTSKVDETVERAKQEGNLPLYGFHDPEAFVNSIEKPRVIIMLVKAGAPVEQTTKTLSAYLEKGDCIIDGDNEWYENTERREKEVAELGILYLGMGVSGGEEGARRGPSMMPGGSFEAYKYIEDILLKVAAQVPDSGPCVTYIGNGGSGNFVKMIHNGIEYGDMQLIAEAYDVLKSVGKLTNEELQSAFTEWNKGELLSFLIEITADIFGIKDDKGDGYLVDKVLDKTGMKGTGKWTVQQAAELSVPAPTIEASLDARFLSGLMDERVEAAKVFKSGGFGDILTDQQVDKKQLIDDVRKALYAAKICSYAQGMNLIRAKSAEKGWDLALGELARIWKGGCIIRAIFLDRIKQAYDRNPNLANLLVDPEFAKEIIERQTAWRRVVSLSVNSGISLPGMSASLAYFDSYRRERLPANLVQAQRDYFGAHTYERVDIEGSYHTEWFKLAKQSRI

SEQ ID NO: 327 - DNA, 1896 bp, Medicago truncatula
tagataccaaaatggattcatttttctttgtctgaaaagattggtggttggtggtcttgatagccatcgtcgagtcgaccattgaatttcaagtttcatttcaactccaaatttaatattacaaattggaaatacattatggctcaaccacttacaagaataggccttgccggactggctgttatgggccaaaatctcgcactcaatattgccgacaaaggattcccaatttctgtttataacagaacaacatcaaaggttgacgaaactgtggaacgagcaaaacaggagggaaatcttccactctatggcttccatgaccctgaagcctttgttaattccattcaaaaaccaagggtgattataatgcttgttaaggctggtgcacctgttgaccagaccatcaaaaccctatctgcgtacctggaaaaaggggattgtataattgatggtggtaatgaatggtatgagaacacggagaggcgagagaaagaggtagccgaattgggtcttctctaccttggaatgggagtttcaggtggtgaggagggtgctcgacgcggtccttctatgatgcctggtggttcgtttgaagcttacaaatacatagaagatattcttctcaaggtggctgctcaagttcctgacagtggcccttgtgtgacatatatcggtaaaggtggatctggtaattttgtgaagatgatccataatggaattgaatatggtgacatgcagctgattgctgaggcttacgatgtgttgaagtcagttggaaagttgacaaacgaggagctacaaagtgcatttaccgaatggaacaagggagaacttttgagtttcctaattgaaatcactgcagatatattcggaattaaggatgataagggtgatggatatcttgttgacaaggttcttgacaaaactggtatgaagggtaccggtaagtggactgttcagcaagcagctgaattatcagttcctgctcccaccattgaagcttcattggatgctaggttccttagtgggttgaaggatgaaagagttgaggctgcaaaggtctttaaatcaggtggctttggcgatatcttgactgaccaacaagtagacaagaagcagttgattgatgatgttaggaaggctctttatgcagccaagatttgtagttacgcacaagggatgaatctgatccgtgcaaagagtgctgaaaagggttgggatttggaattgggtgaacttgcccgtatttggaaaggaggttgcatcattagagctatattcttggacagaatcaagcaggcgtacgacagaaaccctaatctcgctaaccttcttgtggatccagagttcgcaaaggaaataattgaacgccaaaccgcatggaggagagttgtttcccttgctgtcaattcaggtatcagcctcccgggtatgtctgctagtcttgcatattttgactcttatagaagggaaaggttgccagctaatttggtgcaagctcaacgagactacttcggtgctcatacatatgaaagggttgatatcgaggggtcgtaccatactgaatggttcaagcttgccaagcagtcgaggatttagattactgtgtttgaactcttcaagattcctaataaatgtaatgttttttactcaagactgtatactgagttgagcttacatagctgcaatgcggtgaagtttatttataccattctgtactacttaattacttggtttttggttttccaacaattgtgctgtatctttgctgatcttgctttgaatttgatataaaattgtccaacttcaccaaaaataataaaaaaataaataataataatatataaataaaaatataaataagttaaaaaagaataaagaaaaaactgaggggcc

SEQ ID NO: 328 - protein, 486 aa, Medicago truncatula
MAQPLTRIGLAGLAVMGQNLALNIADKGFPISVYNRTTSKVDETVERAKQEGNLPLYGFHDPEAFVNSIQKPRVIIMLVKAGAPVDQTIKTLSAYLEKGDCIIDGGNEWYENTERREKEVAELGLLYLGMGVSGGEEGARRGPSMMPGGSFEAYKYIEDILLKVAAQVPDSGPCVTYIGKGGSGNFVKMIHNGIEYGDMQLIAEAYDVLKSVGKLTNEELQSAFTEWNKGELLSFLIEITADIFGIKDDKGDGYLVDKVLDKTGMKGTGKWTVQQAAELSVPAPTIEASLDARFLSGLKDERVEAAKVFKSGGFGDILTDQQVDKKQLIDDVRKALYAAKICSYAQGMNLIRAKSAEKGWDLELGELARIWKGGCIIRAIFLDRIKQAYDRNPNLANLLVDPEFAKEIIERQTAWRRVVSLAVNSGISLPGMSASLAYFDSYRRERLPANLVQAQRDYFGAHTYERVDIEGSYHTEWFKLAKQSRI

SEQ ID NO: 329 - DNA, 1431 bp, Nostoc punctiforme
atgacactacaaagctttggtgtgattggattagccgttatgggtgagaacatcgctctaaacgtagagcgcaatggcttcccaattgcagtttacaaccgctcccgagaaaaaacggatgcgtttatggcgcagcgtgctacaggacggaacgtcaaagccgcctttactctagaagaattcgttgccttattggaacgtccccgcaaaattctagtaatggtgcaagctggtaagccagtggatgcggtgattgctcaactcaaacccttgttagaggaaggcgatatcattatcgacggtggcaactcttggtttgaagatacggaacgacgcactcaggaattagaacccgctgggcttcggtatcttggtatgggtgtcagtggtggtgaagaaggggcgctgaatggcccatctctgatgcctggaggtacaacaagctcttacgagtttctatcaccaattttcaacaaaattgctgcccaagtcgatgatggcccttgtgtaacctacattggccctggtggttctggccactatgtcaaaatggtacacaacggcattgagtatggcgatatgcagctaattgctgaagcctacgacttgctgaaaaatgtcgctggattaaaccccagtcagctacatgatgtgtttgctgaatggaataccaccgatgaactcgattcatttttgattgaaattacgaagaatatcttcccatatattgacccagaaacaaataaacccctggtggatttgattgttgatgcagcaggtcaaaagggaactggacgctggactgtacaaactgcattggaattgggagttgctattcctacaattacagcagcagttaatgcccggattatatcttcgattaaagatgagcgggttgcagcatctaaagtcctcactggccccagtggcaagtatgacgggcaaactaaagactttatcaataaagtacgtgatgctctctattgctcaaaaatctgttcttatgctcaagggatggcgttgctatccacagcttcaaaaacatataactggaatttggatctgggcgagatggcgcggatttggaaaggtggttgtattattcgcgctcgctttttgaataagattaagaaggcttttagcgaaaatccagctttgcctaacttgctgttagctcccgaatttaagcaaacaattcttgacagacaaactgcttggcgggaagtgattgcgacagctgcaacagttggaattccagtacccgcatttagcgcctccttggattattttgacagctatcgccgcgatcgcttgcctcaaaatctaactcaagcacaacgcgactactttggcgcacatacctacctgcgtcttgataagcccggaagtttccatactgaatgggtacctattgctgaagctggtaagtaa

SEQ ID NO: 330 - protein, 476 aa, Nostoc punctiforme
MTLQSFGVIGLAVMGENIALNVERNGFPIAVYNRSREKTDAFMAQRATGRNVKAAFTLEEFVALLERPRKILVMVQAGKPVDAVIAQLKPLLEEGDIIIDGGNSWFEDTERRTQELEPAGLRYLGMGVSGGEEGALNGPSLMPGGTTSSYEFLSPIFNKIAAQVDDGPCVTYIGPGGSGHYVKMVHNGIEYGDMQLIAEAYDLLKNVAGLNPSQLHDVFAEWNTTDELDSFLIEITKNIFPYIDPETNKPLVDLIVDAAGQKGTGRWTVQTALELGVAIPTITAAVNARIISSIKDERVAASKVLTGPSGKYDGQTKDFINKVRDALYCSKICSYAQGMALLSTASKTYNWNLDLGEMARIWKGGCIIRARFLNKIKKAFSENPALPNLLLAPEFKQTILDRQTAWREVIATAATVGIPVPAFSASLDYFDSYRRDRLPQNLTQAQRDYFGAHTYLRLDKPGSFHTEWVPIAEAGK

SEQ ID NO: 331 - DNA, 1796 bp, Nicotiana tabacum
gaagccacagtgtttgtagaagagaattagaccccgtcacctaaagtttgtttctctccatccataaaacttcacattgggtaggtgacaacatggcttctccgacaagaattggtcttgctggccttgctgttatgggccaaaatcttgctctcaatattgctgagaaaggattccctatatctgtttacaaccgaaccacttcaaaagttgacgagactgttgaacgagctaaaaaagaaggagatcttcctctttatggctttcatgacccagagtcctttgtgaattctatccaaaagcctcgcgtgataatcattcttgtcaaggctggagcaccagttgatcagaccatcaaaaccctttcggcttacatggagaaaggagactgtatcattgatggtggaaacgaatggtatgagaacacagagaggagagagaaagaaatggctgagttaggtcttctttatcttgggatgggagtttcaggtggtgaagagggggctcgaaatggaccttcactgatgcctggaggctcttttgaagcctacaagtacatagaagatatcttactaaaggtcgctgctcaagttcctgatagcggaccttgtgttacatacattggtaaaggtggttctggcaattttgttaagatggtccacaatggaattgaatatggtgatatgcaattgattgcggaggcttatgatgttctgaaatctgttgggaagctctctaacgatgagttgcaacaagttttctcagaatggaacaaaggggagcttctgagcttcttgattgaaatcacagctgatatatttggaatcaaggatgacaaagcagatggatatttagtagacaaggttctggacaagactggaatgaaaggtactggtaaatggactgttcagcaagctgctgaactgtcagttgctgctcctactatagcgtcatcactggattcaagattccttagtggattgaaggatgaaagggtgcaggcagccaaagttttcaaatctagcggggttagcgatatacttgttgaacagtctgtggataagaagcaattgattgacgatgtgagaaaagcactctatgcatcaaaagtatgtagctatgcccagggaatgaatttgataagggcaaagagtgttgaaaagggatgggacttgaaactaggggagcttgctaggatttggaaaggtggttgcattatccgtgctatatttttggatcgtatcaagcaggcttatgacagaaatccagatctcgctaacctgcttgtggatgaagaatttgcaaaggaggtagttgaacgacagtctgcctggcgaagagtggtctgcctttctataagctcgggtatcagcacacctggtatgtcttcaagtcttgcttatttcgactcataccggagggaaaggcttcccgcaaatttggtccaagctcaaagggattactttggtgctcatacttatgagaggactgatatgccgggggcatttcatactgagtggttcaagattgccaaacagtcgaagatctgagtttcttctggttacattcttgccattgacctaattgaataaagttcatgttgtcactgaatctgggaagagagatcctgtggtatcacatcttgtcatctggtctctcaggtgttgaaatttccctatgtttgttgtggagcctatttgtatttctagtccttggcagcttttttctcgtgttatgttttccaagttactgaaaactctcatacaagcaaagaaagtattatccttgttttggat

SEQ ID NO: 332 - protein, 485 aa, Nicotiana tabacum
MASPTRIGLAGLAVMGQNLALNIAEKGFPISVYNRTTSKVDETVERAKKEGDLPLYGFHDPESFVNSIQKPRVIIILVKAGAPVDQTIKTLSAYMEKGDCIIDGGNEWYENTERREKEMAELGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLSNDELQQVFSEWNKGELLSFLIEITADIFGIKDDKADGYLVDKVLDKTGMKGTGKWTVQQAAELSVAAPTIASSLDSRFLSGLKDERVQAAKVFKSSGVSDILVEQSVDKKQLIDDVRKALYASKVCSYAQGMNLIRAKSVEKGWDLKLGELARIWKGGCIIRAIFLDRIKQAYDRNPDLANLLVDEEFAKEVVERQSAWRRVVCLSISSGISTPGMSSSLAYFDSYRRERLPANLVQAQRDYFGAHTYERTDMPGAFHTEWFKIAKQSKI

SEQ ID NO: 333 - DNA, 1925 bp, Ocimum basilicum
gatccatttccttgttttctcctccaattaattactccaatcaatacgcttttcttctctgccaaatttccagatttttgtttcacgggagacccattgctgcctaccccaattcagttgagcagaacatcaagtcaggagaaagagatggctgagcaatctacaaaacggaccagaataggcctcgctgggcttgctgttatgggacaaaatctggccctcaacattgctgagaaaggcttccccatttctgtttataaccggactacatctaaagtcgatgaaactattgaaagagcaaaagctgaaggaaatcttccagtttttggcttccatgatccagaatcatttgtctactccatccagaaacctcgcgtgatcatcatgctagtcaaggctggggcgcccgttgatcagaccatcaaaacactctctgcttacatggagaaaggcgattgcatcattgatggtggaaacgagtggtatgagaatactgagagaagggagaaagctgcagctgaattaggccttctctacctcggtatgggagtttctggtggtgaagagggtgctcgaaatggaccttcactgatgcctggaggctcattcgaagcctacaaatacatcgaagacatcgtcctaaaagtagcagctcaagttcctgacagtggcccctgtgtgacctacattggcaaaggaggatcagggaattttgttaagatgatccataatggaattgaatatggtgatatgcagctgattgctgaggcttacgacgtgctgaaatcagttggaaaactgtcaaatgaggagctgaaaaacgtcttctcagactggaacaagggtgagctccagagcttcttgattgagatcactgctgatatcttcggcatcaaggatgacaagggagaaggctatttggtcgacaaggtgctggacaaaacgggtatgaaaggcaccggtaaatggacagttcagcaagctgcagagctctcaattgcagcccccaccatcgaagcctctctagattcaagattcctaagcgggttgaaggaggaaagaaccgaggctgctaaagtcttcaaatctggtggctttggagacattatagctgatcaagaggttgacaaggagaagctgattcatgatgtgaggcaggctctctacgcatctaaaatatgtagttatgcccaaggaatgaatctgatccgcgcaaagagcattgagaagggatgggagctgaagttgggtgagctggcaagaatctggaagggtggctgcatcatccgtgctatcttcttggatcgaatcaagaaggcttacgataggaatgctgatctggccaacctgcttgtggaccctgaatttgcaaaggaaatcattgagaggcagtctgcttggagaagagtggtgtctcttgcaatcaactcgggcatcagcactcctggaatgtcagctagccttgcgtattttgatacttacagaagggagagattgccagctaatctggtacaagctcagagagactattttggtgctcatacatatgaaagggttgatattccagggtcctaccacactgagtggtttaagattgctaagaacatcaataactgaggcttctctttcgagttccctaataaataatttgcatgattcataaatgtcatttgacatgacccccatcctcatatcgttctagctggcaggatacaagatctcaaagtttcgatgaagtttccattattctggctcacttttgttgtgattgccgttattgtactttgcttttgtatttcatatttactttatctcatcctttgaagaagtgtgttatcactggaaggtttgaggttttctacatttatctatatgaaatgtctgatatcttgagattacatggagtttgttgttgagatgtttcg

SEQ ID NO: 334 - protein, 489 aa, Ocimum basilicum
MAEQSTKRTRIGLAGLAVMGQNLALNIAEKGFPISVYNRTTSKVDETIERAKAEGNLPVFGFHDPESFVYSIQKPRVIIMLVKAGAPVDQTIKTLSAYMEKGDCIIDGGNEWYENTERREKAAAELGLLYLGMGVSGGEEGARNGPSLMPGGSFEAYKYIEDIVLKVAAQVPDSGPCVTYIGKGGSGNFVKMIHNGIEYGDMQLIAEAYDVLKSVGKLSNEELKNVFSDWNKGELQSFLIEITADIFGIKDDKGEGYLVDKVLDKTGMKGTGKWTVQQAAELSIAAPTIEASLDSRFLSGLKEERTEAAKVFKSGGFGDIIADQEVDKEKLIHDVRQALYASKICSYAQGMNLIRAKSIEKGWELKLGELARIWKGGCIIRAIFLDRIKKAYDRNADLANLLVDPEFAKEIIERQSAWRRVVSLAINSGISTPGMSASLAYFDTYRRERLPANLVQAQRDYFGAHTYERVDIPGSYHTEWFKIAKNINN

SEQ ID NO: 335 - DNA, 1754 bp, Ostreococcus lucimarinus
gattgcgcgacgcggccatggcgtgcgcggcgagatcggcgacgacgaacgcgacgacggcggcgcggagacgcgaagcgacgacgcgcgcgggacgacgacgcgggatgacggcgacggcgcgcgcgacggcggcgaacggggcgggcgaaaagtcgcggatcgggctgtgcggactcgcggtgatgggacaaaacctggcgctgaacgtggcggagaagggattcgacatctcggtgtacaatcgatcgagcgataagacggacgtgtgcgtcgaacgggcgaagaaggagggattgggggcgaaactgcgagggtatcacgagatgaaggatttcgtggcgtcgctggcgaagccgcgatgcgtgataatcttggtgaaagcgggcgcgcccgtggacgccacgatcgcgggattgtcgcagtttctcgaacctggagattgcatcatcgatggtgggaacgagtggtacgaaaacaccgaacgacgatcgaaggaggcggcggagaagggattgctgtacgtcggcatgggcgtgagcggaggcgaggagggcgcgcgcaacggaccgtccatgatgccgggtgggtccaaggaagcgtacgatatcatcgctgatatcttaaagcccgtgagcgcgcagaccgattcgggggcgtgcgtgacgtacgtcggcccaggaggcgccgggaactttgtcaagatggtgcacaacggcatcgagtacggcgacatgcaactcatctccgaagcgtacgacgtgttgaaaaccgtcggcgggttgacgaacgatgaactcgcggctgcgttcacggaatggaacgaggcggagttggaatcgtacctcatcgagatctccagcatcattttggccaagaaggacgaccagtctggcaagagcgacgactttttggtggacaagatcctcgacaagactggcatgaagggcactggaaagtggacggtgcagcaagccgcggaattgtccatcgctgcgccgacgatcgcgagctctcttgacgcccgatgcttgtccggattgaaggatgaacgcgtcaacgccgaggcgttttacgccaagctcggcttggcacccgccggcgccatgggcccggcggacaaaaagcaactcatcaacgacgtgcgatatgctctgtacgcttccaaggtgacttcctacgcccaaggcatgaacctgattcgcgccaagtccaacgagcaaggctggaacttgaacctcggcgaaatggcgcgcatctggaagggcggctgcatcattcgcgccggcttcttggaccgcatcaagaacgcttacgaccgagactccaagctcccgtctcttctcgttgacgagcagttcgccaaggaaatgatcgaacgcgaagcttcgtggcgtcgcgtcgtcaccgccgccatcaacgccggtgtttccgtgccgtccatgagcggttctctcgcgtactttgacacttaccgccgcgcgcgctcgccggcaaacttggtgcaagcgcagcgtgacttcttcggttcgcacacgtacgaacgcaccgacatggaaggctggtatcacacgctctggagtgatatgaacagcgctgacagcatcaccacgtctggctacaaggcgtaaataaaagcgatgatggtccgtcgcccgtcgggatttttgttttattcaccgatgagggagcttttccttctcttagcgcgcgccgcaagcatgcctgcttcatagtaaattcgctcaggcgtt

SEQ ID NO: 336 - protein, 537 aa, Ostreococcus lucimarinus
MACAARSATTNATTAARRREATTRAGRRRGMTATARATAANGAGEKSRIGLCGLAVMGQNLALNVAEKGFDISVYNRSSDKTDVCVERAKKEGLGAKLRGYHEMKDFVASLAKPRCVIILVKAGAPVDATIAGLSQFLEPGDCIIDGGNEWYENTERRSKEAAEKGLLYVGMGVSGGEEGARNGPSMMPGGSKEAYDIIADILKPVSAQTDSGACVTYVGPGGAGNFVKMVHNGIEYGDMQLISEAYDVLKTVGGLTNDELAAAFTEWNEAELESYLIEISSIILAKKDDQSGKSDDFLVDKILDKTGMKGTGKWTVQQAAELSIAAPTIASSLDARCLSGLKDERVNAEAFYAKLGLAPAGAMGPADKKQLINDVRYALYASKVTSYAQGMNLIRAKSNEQGWNLNLGEMARIWKGGCIIRAGFLDRIKNAYDRDSKLPSLLVDEQFAKEMIEREASWRRVVTAAINAGVSVPSMSGSLAYFDTYRRARSPANLVQAQRDFFGSHTYERTDMEGWYHTLWSDMNSADSITTSGYKA

SEQ ID NO: 337 - DNA, 1757 bp, Oryza sativa
gctgcacgcctttccgcgatttcgtcagttacccagatctcatcttacgcaggcagagatggctgtcactagaattggtcttgctggccttgcggtcatggggcagaaccttgccctcaacattgcagagaaagggttccctatctctgtctacaacaggacgacttctaaggttgatgagaccgttcagcgcgccaaggtagaaggaaaccttcctgtgtacgggttccatgaccctgcatcctttgtgaactccattcagaagccacgtgttgtcatcatgcttgtcaaggctggtgcaccagtggaccagaccattgcaactcttgcagcacacttggagcagggtgactgtattattgatggaggaaatgagtggtacgagaacactgagaggagggagaaggcaatggaggagcgtggcctcctctatcttgggatgggtgtttccggaggagaggagggtgcccgcaatggcccgtccttgatgcctggtggctcattcgaggcgtacaagtacattgaagatattcttctcaaggtggctgcccaggttcctgatagtggcccgtgcgtcacatacattggcaaaggtggatctggaaactttgtcaagatggttcacaacggaattgagtatggtgacatgcaactgatttctgaggcatatgatgttctcaagtcagttggtaagctcacaaacagtgagctgcagcaggtgttttctgagtggaacaagggtgagctcctcagtttcctgattgagatcacagccgacatatttagcatcaaggatgaccagggttcaggccacctggtcgacaaggtcctggacaagactgggatgaagggaactgggaagtggactgtgcagcaggccgcagagctttctgtggctgctcctacaattgaggcatccttggattccaggttcctcagtgggttgaaggatgagcgtgttgaggctgccaaggtcttccaaggtgacttctccagcaacttgccagtggacaaggcacagctgattgaagacgtgaggcaggctctttacgcctcgaagatctgcagctacgctcagggcatgaacatcatcaaggccaagagcatggagaaagggtggagcctcaacctcggtgagctagcgaggatctggaagggagggtgcatcatccgtgccatcttcctggaccgcatcaagaaggcctacgacaggaactccgacctcgccaacctgctcgtggaccctgagttcgctcaggagatcatggacaggcaagcggcatggcgcagggtggtctgccttgccatcaacaatggcgtcagcaccccaggcatgtcggcgagtctcgcgtacttcgactcctaccggagggacaggctgcctgccaacctggtgcaggcacagagggactatttcggggctcacacctacgagagggtcgacatgcccggctccttccacaccgagtggttcaagatcgcgcgtgctgctaagatgtgaaatgcttcaaattttcggtaatatttggttgctgcttgctgctgagtcgcttgtagggtgggaggaactgttgttaaattttatggtcaatgtgctacgcttaatttggataaggaggtccatagctatctccattcttttaatgtaaggagcagcccagggtggagagaacatggatatttatcattggaacctttgttgtgatctttgtaagtctatatatgaataaaagcattttggcaatgcttgctttttt

SEQ ID NO: 338 - protein, 480 aa, Oryza sativa
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 339 - DNA, 1890 bp, Oryza sativa
atctcttcaccattctcaacccccccccccccccatctccacctcctcctcctccgccgccgccgaacccgatggcctccccggcgccggcgccgcccgcggcctcctcctccgcggcggggtccgccccgccgccgcgcatcggcctcgcggggctcgccaccatgggccagaacctcgccctcaacatcgccgagaagggcttcccgatctccgtctacaaccgcaccgccgccaaggtcgacgccaccgtgtcccgcgccgaggccgagggcgcgctcccggtgctcggccaccgcgacccgcggggcttcgtcctctccctctccaggccccgcaccgtcgtgctgctcgtccaggccgggcgcgccgtcgacgccaccatcgacgcgctcgtcccctacctcgacgccggggacgccatcgtcgacggcgggaacgagtggtaccagaacacggagcggcggatcgaggaggccgccgcgagggggatactctacctcgggatgggggtctccggcggcgaggagggcgcgcggaacgggccctcgctgatgccggggggccacatcgacgcctacaacaacatcagggacatcctcgagaaggccgccgcgcagacggaggatggggcgtgcgtcaccttcgtcggccccggcggcgcgggcaacttcgttaagatggtgcacaacgggatcgagtacggcgacatgcagctcatcgccgaggcctacgacgtgctccgccgcgtcggcggcctgtccaactcggagatcgctgacgtcttcgcggagtggaaccggggggaattggagagtttcttggttgagattactgccgatatattcacggtggccgacccgcttgatggcagcggcggcggtgggctggtggacaagattcttgacaagacggggatgaagggaaccgggaagtggacggtgcagcaggcagcagagcttgcgattgctgcgcccacgattgcagcatcactggatgggaggtacttgtctgggttgaaggacgagcgtgtggcggccgcaggggttctagaggcggaggggatgccatcagggctactcgagacgattaatgttgataagaagatgctagttgacagggtgaggcaagctctgtatgcgtcaaagatttgcagctacgcgcaggggatgaaccttctgcgagcaaagagtgtggagaaggggtggaatcttaacctcgcagagcttgcaaggatttggaagggcgggtgcattatccgggcgaagtttcttgataggatcaagaaggcgtatgacaggaaccctgagctggccaatctgatcgtggacagggagtttgcaagggagatggttcagcggcagaatgcatggcggtgggttgtggctcgtgctgtggaggctgggattagcactccagggatgtctgctagcctttcatactttgacacctacaggtgtagtcggctgcctgcaaatctgatccaagcacagagagacttgtttggggcacacacctatgagcgcattgaccgtccaggttcgttccacacagagtggactaagctggcgagaaagagtaatggtgcggccatttgaggacttgaatggtatcagtaactctgtgtggtgtctctttgtgggttctctttgaattcactactgttgtctttatgattctaggtctgaattctgtactttgaataatgaagtgtcatgtgcggtatgcatggaaggaacattcatgtagcttgtgcttttatatggtctaggtgcacccattcagttttctcataaatttggaatgcaatggttttaccctcttatcaaatccctgtaattttgatctggcatgtgtcattatagctagtaagacacgtgatgtttggcc

SEQ ID NO: 340 - protein, 508 aa, Oryza sativa
MASPAPAPPAASSSAAGSAPPPRIGLAGLATMGQNLALNIAEKGFPISVYNRTAAKVDATVSRAEAEGALPVLGHRDPRGFVLSLSRPRTVVLLVQAGRAVDATIDALVPYLDAGDAIVDGGNEWYQNTERRIEEAAARGILYLGMGVSGGEEGARNGPSLMPGGHIDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKDERVAAAGVLEAEGMPSGLLETINVDKKMLVDRVRQALYASKICSYAQGMNLLRAKSVEKGWNLNLAELARIWKGGCIIRAKFLDRIKKAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 341 - DNA, 1882 bp, Physcomitrella patens
gtgggtctcggctatggcatcgatgtatgaatagaaagcattggtgagacgatcagtttgttagagatcggtcggtgtctggcttcgatagggtctggtgaagagcgagcgcaacactgcgttgtgaattgggtatccgtcttggaagggaatcgggtgccgggtgggggagagatggcgtccgatggcctttcgagaattgggttggcggggttggcagtgatgggtcagaacttggctctcaacattgcggagaagggtttcccgatttcggtctacaatcgatcagcgagcaaggtggatgagaccgtagagcgcgcgaaggaggaggggaatttgcccgtgaaggggttcaaagatccctgcgagtttgtgaagtcgattcagaagccgcgatgtatcatcatcttggtgaaggcagggtcgccggttgatcagaccatcgagctcttgtcgaagtacctcgagaagggggactgtatcattgatggagggaatgagtggtacgagaatacggagaggagggcggagaaggtgaaggagaagggtttgttgtacctggggatgggagtcagtggaggcgaggagggtgctcgacatggaccttcgctcatgcccggaggaactctagaagcgtacaagtacattgaagacattgtgcagaaagtggctgcgcaagtcgacagtggtccatgtgtgacctacgttggccccggaggcgctggcaacttcgtcaaaatggtgcataatggaattgagtacggtgacatggagctcatcgccgaggcgtacgatgtgctcaaatccgtgggtggtttatcgaacaaggagctgcacgaaaccttctacgagtggaacaagggcgaacttgaaagctttctaatcgaaatcactgctgatattttctctgtcccggatgacaagggtgaaggagaactcgtcgataaagtgctggacaagacgggcatgaagggtactggcaagtggaccgtgcagcaagctgccgaattatctgtggccgctcctactattgcgacatccctagacttgcgatacctttcaggtttgaaagaggaacgcgtggaagccgccaaagtattcaaaagtttgggagtcagtgatttattagcagaggttaaagttgacaaacaggagctcatcgacaacgtccgaaaagccctgtatgcctcgaagatttgcagttacgcgcaaggcatgaacctcattcgtgcaaagagcattgagaagggttggaatttggacctcggagaactcgctcgtatttggaaaggtgggtgcattattcgagccaagtttttggaccgcattaagcaagcttacgacagggacccaaaattggcaagcttgttgatagaccctgaatttgcgaaggagatggtagagagacaaggtgcatggaggaaggttgtgtctttggcaatcgaagttggggtgagcaccccaggtatgagcgccagtctcggttactttgatacgtacaggcgagctcggcttccagcaaatcttgtccaagctcagcgcgattactttggttcccatacttacgagcgtgttgacatgaaagactccttccacacggagtggtacaagattgcgaagaagctgttgggcgacagggcggctactgagggtgacctcaaaatcggctccaaagagcagaagcattaggtgtacgtacgcagtgcatgtaagaaggtaactacagacttgtaaattcaccgccgatctttattaattcgagggaatcgagcttgtaattagctaattctgagcccgattagggtcagagtgagcaccctggggctagaaatgtgctgcacgacgggcataaataataaatgcattgcaccccgattctggt

SEQ ID NO: 342 - protein, 504 aa, Physcomitrella patens
MASDGLSRIGLAGLAVMGQNLALNIAEKGFPISVYNRSASKVDETVERAKEEGNLPVKGFKDPCEFVKSIQKPRCIIILVKAGSPVDQTIELLSKYLEKGDCIIDGGNEWYENTERRAEKVKEKGLLYLGMGVSGGEEGARHGPSLMPGGTLEAYKYIEDIVQKVAAQVDSGPCVTYVGPGGAGNFVKMVHNGIEYGDMELIAEAYDVLKSVGGLSNKELHETFYEWNKGELESFLIEITADIFSVPDDKGEGELVDKVLDKTGMKGTGKWTVQQAAELSVAAPTIATSLDLRYLSGLKEERVEAAKVFKSLGVSDLLAEVKVDKQELIDNVRKALYASKICSYAQGMNLIRAKSIEKGWNLDLGELARIWKGGCIIRAKFLDRIKQAYDRDPKLASLLIDPEFAKEMVERQGAWRKVVSLAIEVGVSTPGMSASLGYFDTYRRARLPANLVQAQRDYFGSHTYERVDMKDSFHTEWYKIAKKLLGDRAATEGDLKIGSKEQKH

SEQ ID NO: 343 - DNA, 2100 bp, Physcomitrella patens
aggcctatcacattgttttgcccatttggcatcaagacattgcgatatcttccacgctggtgcttcttctcaatccttttctctcgcttacccaccttgtgtattgctcgcattctgactctacggtgaggttcttgagtttttctgtgggttctcgagaaggatttgagcaatggcggaagcagttgctgccggagtgggggtgtcgagaatcggtctggctggtttggccgtcatgggccagaacctagccctgaacattgcggagaaggggttcccaatatccgtgtacaatcggacggactctaaggttgatgagactgtggagcgggcgaaggaagagggcgatttgcctctggttggattcaaggatcccaaggagtttgtgttgtccatccagaaaccccgctccatcatcattctggtgaaagctggcgcgcctgttgaccagaccatccagactctgtcgcagtacatggagcctggcgattgtatcattgacggagggaatgagtggtacgagaataccgagaggagggcgaagcaggttgctgagaaagggctgttgtacttgggaatgggagtctcgggtggagaggaaggagcccgtaatggaccttctatgatgcccggtggcacagaggaggcctaccattatatcgaagatgtggtctcgaaggtcgccgcccaagttgacgatgggccgtgtgtgacatatgtaggccaaggcggggccggaaactacgttaaaatgattcacaatggaatcgaatatggtgacatgcagctgatctcggaggcttacgatgtgttgaagtcagtcggaggattgacaaatgaagaattgcatgagactttcgctgagtggaatgaaggagaactggagagtttcctggttgaaatcactcgtgacattttctccgtcaaggatgacaaggctgagggattccttgtcgacaaaatcctcgacaagacgggcatgaaaggaactgggaagtggaccgtgcagcaggccgcggagctttccattgcggctcccaccattgctgcttcacttgattctcgtttcctttcagggttgaaggaggagcgcctggaagcggcacgtatattcaaggaagccggagttgatgatatcatagctgtgaagaaccttgacaagaaagtgctcgtcgatgacgttagaaaggctctatatgcctccaaaatctgtagctatgcgcaaggcatgaacctcatccgtgccaagagcattgagcaaggctggaaccttaacctcggtgagctcgcccgcatctggaagggaggctgcatcatcagggccaaatttctcgaccgcatcaaaaaggcttacgaccgcaaccctgagctcgcatctcttctgatagatcccgaattcaccaaggagatggtggaaagacaatctgcatggcgccgagtggtgtctctggctattgaggtcggtgtgtctactcccggtatgactgccagtcttgcatacttcgacacgtatcggagaggtcgccttccagccaacctcgtccaagctcaacgggactactttggtgcccacacatacgagcgtattgatatgcccggatcttaccacacggagtggtttaagattgccaagcaattcgtgaactccaagacccctgtgaaggcctcggcttagataaactcccaagatatgagtcaattctcaagtatcctctggtactcccttcgaagaggtccataaattaggtgagctattcgcatctgtacaattagaggtggtggacctggtctggtctttagcaattggttctagacatcaatcaaattttgtaccttttgtctgggcaagttattagttaggtgctagctttatgtggtgttgtgatgagaatctgataagggaatgagaatggttcgctctaccatcattcgcattcagcgtgctgcgcactccatcatgacgtttcattcatgatggatcctcaagtgcataggtactctggtatgtagcatttgaacattgtattgaattctcaattgtaaccgagcttgtaaccgaacctattgaaacacgttttgaaattttactgttttcttttc

SEQ ID NO: 344 - protein, 500 aa, Physcomitrella patens
MAEAVAAGVGVSRIGLAGLAVMGQNLALNIAEKGFPISVYNRTDSKVDETVERAKEEGDLPLVGFKDPKEFVLSIQKPRSIIILVKAGAPVDQTIQTLSQYMEPGDCIIDGGNEWYENTERRAKQVAEKGLLYLGMGVSGGEEGARNGPSMMPGGTEEAYHYIEDVVSKVAAQVDDGPCVTYVGQGGAGNYVKMIHNGIEYGDMQLISEAYDVLKSVGGLTNEELHETFAEWNEGELESFLVEITRDIFSVKDDKAEGFLVDKILDKTGMKGTGKWTVQQAAELSIAAPTIAASLDSRFLSGLKEERLEAARIFKEAGVDDIIAVKNLDKKVLVDDVRKALYASKICSYAQGMNLIRAKSIEQGWNLNLGELARIWKGGCIIRAKFLDRIKKAYDRNPELASLLIDPEFTKEMVERQSAWRRVVSLAIEVGVSTPGMTASLAYFDTYRRGRLPANLVQAQRDYFGAHTYERIDMPGSYHTEWFKIAKQFVNSKTPVKASA

SEQ ID NO: 345 - DNA, 1981 bp, Prunus persica
cccagatcttcgccttcctggttttgctcagattttcaatccagttctttcgttagagaagaaaacgttcagacagaggaaaagatggctgcaccaccgaaacctacaagaataggccttgctggtttggctgtcatgggccaaaatttggccctcaacattgcagagaaaggcttccccatttcagtatataatagaactacctccaaagttgatgagactgttgagcgagctaaaaatgaaggaaatcttcccctttatggcttccatgatcctgaatcttttgttaattcaatccagaaacctcgggtcattatcatgcttgtcaaggctggggcacctgttgaccagaccataaagaccctctccgtctacctggagaagggtgacagcattattgatgggggtaatgagtggtatgaaaatactgagaggagggcgaaagccatggctgaattaggtcttctttaccttggaatgggagtttcaggtggtgaagagggggctcgatatgggccctctatgatgcctggaggatcctttgaggcctataagtacattgaagacattcttcttaaggtgtcagctcaagttccagacagtggcccctgtgtgacttacattggcaaaggtgggtctggtaactttgttaagatgattcataatgggattgaatatggtgatatgcagctgatagcagaggcttatgatgtactgaagtcagttggaaagctgtcaaatgaggaactccgaagcgttttctcagagtggaacaagggagagcttctgagcttcctgattgaaatcactgcagatatatttggaatcaaggatgataagggagatggatatttggttgacaaggttttggacaagactggcatgaagggtactggtaaatggactgttcagcaagctgctgaactatcagttgcagctcccacaattgaatcttctttggatgcaaggtttctcagtggtttaaaggaagagagggttaaagcagctaaagtgttcaaatcagctggttttggtgatatcttgactgccccagaggtggataaggcaaagttgatcgatgatgtgaggcaagctctttatgcatccaagatatgcagttatgcacaagggatgaatcttatccgtgcaaagagtattgagcagggatgggacttgaagttgggggagttggctaggatttggaaggggggctgcatcattcgagcagtgttcctggacagaattaagcaggcatatgataggaatgctgatcttgcaaatcttcttgtggacccagagttttcaaaggagatcattgagaggcagtctgcctggagaagggtggtatgccttgctatcaactcaggcatcagcaccccaggtatgtcagctagtcttgcttattttgacagctacaggagggagagactgccggctaatttggtccaagctcagcgagactactttggtgctcatacatatgaaagaactgatgtagaaggtgctttccatactgaatggttcaaaattgccaaacagtcaaagatttaagtccatcttctttggcattctacttaagcagaactctcctttatcccaataatttctgctgacgattttatgctgggcagagcttcagccaactcttttatcaattttatttaaatcaaggagtgtgcattagatttggtttgttatgcttgtacttttggcagatctgtcaccctcacagcccttttcatttttggaagatgtaattctagtcattgtggaggactgtggggtagcactctgaaactgtaatgttggaagatgaaaatcaatgaagaaactttcttatattcctcaatgttctgcaggtgttttttttccctctttgtaatttttccttccgttattgacagctttttttactttgctttttgggtgtaaatgcgtttcacgatttgaataatgtggctagcatgtgctaattcacttt

SEQ ID NO: 346 - protein, 488 aa, Prunus persica
MAAPPKPTRIGLAGLAVMGQNLALNIAEKGFPISVYNRTTSKVDETVERAKNEGNLPLYGFHDPESFVNSIQKPRVIIMLVKAGAPVDQTIKTLSVYLEKGDSIIDGGNEWYENTERRAKAMAELGLLYLGMGVSGGEEGARYGPSMMPGGSFEAYKYIEDILLKVSAQVPDSGPCVTYIGKGGSGNFVKMIHNGIEYGDMQLIAEAYDVLKSVGKLSNEELRSVFSEWNKGELLSFLIEITADIFGIKDDKGDGYLVDKVLDKTGMKGTGKWTVQQAAELSVAAPTIESSLDARFLSGLKEERVKAAKVFKSAGFGDILTAPEVDKAKLIDDVRQALYASKICSYAQGMNLIRAKSIEQGWDLKLGELARIWKGGCIIRAVFLDRIKQAYDRNADLANLLVDPEFSKEIIERQSAWRRVVCLAINSGISTPGMSASLAYFDSYRRERLPANLVQAQRDYFGAHTYERTDVEGAFHTEWFKIAKQSKI

SEQ ID NO: 347 - DNA, 1965 bp, Pinus taeda
tacatcgatatttcaaaagctgtgaggttcgatcttgggagctctccacagcaccgaagtgctcgagtgagggagcttcttgctttcagtggaagaggtttttgggttttatggttatatattgatatcccaactcctgtgaggttcgatcgtgggacctctgagtgtttaagtttcttcatttctgttcaagaagtttagagtctctgtggttttccttttgtatcaatggaggcgggggcgctgtcgagaatcgggctcgcgggtctggcagtgatgggccagaacctagccctcaacgtcgcagagaaaggcttcccgatctctgtctataatcgcacagcaagtcgcgtggacgaaaccacggagcgcgcccgggacgaaggcgacctgcccctaaagggctattacaatcccaaggacttcgtgctttcgatcaagaagccgaggtcagtgatcatccttgtcaaggcgggggcgccagttgaccagacaatctccacgctctccgactacatggagcctggcgattgcatcgtcgatgggggcaacgagtggtacgagaacacggagcggcgggcaaagcaggtcgctgagaagggcttgctgtatttgggaatgggggtctctggtggtgaggagggggctcgctatggcccgtcgctaatgcctggtggcaccatcgaggcttacaggtatatcgaagacgtcctcaccaaggtcgctgcgcaggtcgatgacgggccctgcgttacgtacgttggcaacggaggggccgggaactttgtcaaaatggttcacaatggcatagagtatggagacatgcagttgatctccgaagcatatgatgtgctcaagattgttggaggtctgagcaatcaggaactggcggagacctttgcggagtggaacaaaggtgagctcgagagctttttggttgagataactgccgatatttttactgtgaaggatgatcatggcggtggggagcttgtagataagatattggataagaccggaatgaaggggactgggaaatggactgtgcagcaggctgcagagctctctgttgcagcacccacaattgctgcctcgcttgattgcaggtatctcagtggcctgaaagaggagcgcgaggccgctgcgaagattttcaaagaggccggcctgcctgatgttttggttggtggaggtaccgtcgacaagaggcaattggtcgatgatgtccgcaaggcgctgtacgcgtcaaagatctgcagctatgcacaggggatgaatctgcttcgcgctaagagtacggagaaggcgtggaatctgaatctcggggaattggctcgtatctggaaagggggctgcattatcagggctattttcttggatcggatcaagaaggcctatgaccggaacccgcagcttccgagtcttttggtcgatccggagtttgcgagagagatggtggagaggcaggctgcttggaggagagtggtgaatttggcaatcaatgctggaatcagcaccccaggaatgaatacaagtctggcctattttgacacttaccgccgtgcccggttgcctgccaatcttgtccaggcacaacgggacctgttcggtgcacacacctatgagcggatcgatcgccctggttctttccacacagaatggacaaagattgctaagcagaacaaagaatacaagtgaagttgctatccaggttcaaattatgcttctgttgacaaaattcaaattcttaagcaggcaccctgagttctgcccgtcagttttgaatttcgtttgacatatagagctatttttcagttaagcgcatctttccggccttttttcttattccagtgggcatggttcatttatgacctgattctaggaaaattgaaaactatgggcttttactttttccaaatattgcatccaataaatgaatggcattggaagaaagttaatggtttt

SEQ ID NO: 348 - protein, 489 aa, Pinus taeda
MEAGALSRIGLAGLAVMGQNLALNVAEKGFPISVYNRTASRVDETTERARDEGDLPLKGYYNPKDFVLSIKKPRSVIILVKAGAPVDQTISTLSDYMEPGDCIVDGGNEWYENTERRAKQVAEKGLLYLGMGVSGGEEGARYGPSLMPGGTIEAYRYIEDVLTKVAAQVDDGPCVTYVGNGGAGNFVKMVHNGIEYGDMQLISEAYDVLKIVGGLSNQELAETFAEWNKGELESFLVEITADIFTVKDDHGGGELVDKILDKTGMKGTGKWTVQQAAELSVAAPTIAASLDCRYLSGLKEEREAAAKIFKEAGLPDVLVGGGTVDKRQLVDDVRKALYASKICSYAQGMNLLRAKSTEKAWNLNLGELARIWKGGCIIRAIFLDRIKKAYDRNPQLPSLLVDPEFAREMVERQAAWRRVVNLAINAGISTPGMNTSLAYFDTYRRARLPANLVQAQRDLFGAHTYERIDRPGSFHTEWTKIAKQNKEYK

SEQ ID NO: 349 - DNA, 1932 bp, Pinus taeda
ttcgttccgacgctctcccccctgtcggaaccagttcctttcggtgtaagaggttgttcgagttctgtgattgcttgttactccaatggagggagcagtgctgtctaggatcggactggcaggtctggcagtgatgggccagaaccttgccctcaacgtcgcagaaaaaggctttccaatctctgtctacaatcgcacgataagccgcgtggacgaaaccctggaacgcgcacgggacgaaggcaacctcccactgaagggcttctacgaccccaaggacttcgtgctatcgatccagaaaccgagggcagtggtcatcctcgtcaaggccggggctccggtcgaccagaccatttcgacgctcacggagtacatggagcccggcgactgtatcgtagacgggggcaacgagtggtacgagaacaccgagcggagggcaaagcaggtggccgagaagggcttgctctacttgggaatgggggtctccggaggcgaggagggagctcgcaacggcccttcgctcatgcctggtggcaccctcgaggcctacaggtatattgaagacgtggtcaccaaggtcgctgcccaggtggacgatgggccctgcgttacttatgtgggagctggaggtgccgggaattttgtaaaaatggttcacaacggcatcgagtatggagacatgcagttgatctctgaggcctatgatgtgctcaggtatgtcgggggtttgaccaatgaggagctttcggagacctttgcagagtggaacagaggtgagctcgagagctttttggttgagataactgcagatattttcactgtgaaggatgagtatagtgatggggagcttgtggataagatactggataagactggcatgaaggggacaggaaaatggaccgtgcagcaggctgcagagctctctgttgcagcccccactattgctgcctcgcttgattgcaggtatctgagtggcctgaaggaggagcgtgaggctgctgcaaagattttcaaacaggctggcctgtctgatgtcgtggctggtgggggaattgtggacaagaagcagttggttgatgatgtccgcaaggcactgtatgcctctaagatctgcagctatgcccaggggatgaatcttctccgcgccaagagtgcggagaaggcgtggaatctgaactttggggaactggcccgtatctggaaaggcgggtgcattatcagggctgttttcttggatcggatcaagaaggcctacgaacggaacccacagcttgcaagcctcttggttgatccagattttgcgagagagatggttgagagacaggctgcttggagaagggtggtgaatttggcaatcagtgctggcatcagcaccccgggtatgaatacgagtcttgcctattttgatacttaccgccgtgcccggttacctgctaatcttgtccaggcacaacgggacctgttcggtgcacatacctacgaacggatcgattgccctggttctttccatacagaatggacaaagattgctaagcagaacagggctgggctgaaggcctgaaagtgaatttgttccccaggttcaaattatgtttctgctgaacaaattcctatacatgcagcctgagttctgcctgtcagtttgacattaagagccttttttcagcttgcatgctttttttatttcatgattgtaggagagttgaaaattgcatgccttcctttttccagagaatgtatccaataaatgtcacgggtagaatgttatcagagatatttttaggagcaaaatttagccctttggcaaattttgctaaataattttatgtgtgccaatatttttctatgcagttgaaagagcacgactaacaaacccattgaggttttttttttaaatattagatgcagtgcatgggttgttctttccgtttt

SEQ ID NO: 350 - protein, 491 aa, Pinus taeda
MEGAVLSRIGLAGLAVMGQNLALNVAEKGFPISVYNRTISRVDETLERARDEGNLPLKGFYDPKDFVLSIQKPRAVVILVKAGAPVDQTISTLTEYMEPGDCIVDGGNEWYENTERRAKQVAEKGLLYLGMGVSGGEEGARNGPSLMPGGTLEAYRYIEDVVTKVAAQVDDGPCVTYVGAGGAGNFVKMVHNGIEYGDMQLISEAYDVLRYVGGLTNEELSETFAEWNRGELESFLVEITADIFTVKDEYSDGELVDKILDKTGMKGTGKWTVQQAAELSVAAPTIAASLDCRYLSGLKEEREAAAKIFKQAGLSDVVAGGGIVDKKQLVDDVRKALYASKICSYAQGMNLLRAKSAEKAWNLNFGELARIWKGGCIIRAVFLDRIKKAYERNPQLASLLVDPDFAREMVERQAAWRRVVNLAISAGISTPGMNTSLAYFDTYRRARLPANLVQAQRDLFGAHTYERIDCPGSFHTEWTKIAKQNRAGLKA

SEQ ID NO: 351 - DNA, 1919 bp, Pinus taeda
attgctaaactgcaagttctgagttctgaaaatttgaactacccagttgattatctgaggttctgaatacacccaactgaatttgaggcaaatagattatagcccacaagtgcttcagagagtagaagagaaatggcttcgtcagatttgtccagaatagggttggctggcctggctgtgatgggccagaatcttgctctcaatattgcagagaaaggcttccccatctcggtctacaacaggagcagtgaaaaagtggatgagactgttgagagagccaaggttgaaggtaatctgcctgtgaagggcttccatgacccaaaggattttgtgaattcaatccagaagcccagagttataatcctgctcgtcaaagcaggactcccagtggacaaaacaatagaaaccctatccgcccacatggaggaaggggactgcattgtggatggtgggaatgaatggtatgaaaacacagagaggagacaggaggctgccaagcagaaagggctgctgtatttggggatgggagtctctggcggtgaggaaggagccaggcatggcccctctctgatgcccggagggtcatttgaagcctacaagtacatcgaggacatactgctcaaggtggctgcacaggtcgacagtggaccatgtgtgacttacattggtaaaggcggagcaggcaattttgtcaagatggtgcataatggcattgagtatggagacatgcagctcattgcagaggcttatgatgttctcaagtcagtcggtaagctcactaacgaagaactgcaccaggcttttgataattggaataagggggaattgtgtagttttttggtagaaatcactgcggatatctttgggatcaaggatgataagggggatgggtatcttgtggataaagttctcgataaaactggcatgaagggcactggtaagtggactgtgcaacaagctgcagatctgtctgttgcagcccctaccattgctgcttctttggattctaggtttcttagtggattgaaggaggaaagggtggaggcctccaaggtgttcaagaatgtagatgtgggtactgtgccagatttggataagactaagcttattgatgatgtgaggcgggctctgtatgcatctaagatatgtagttatgcccaaggaatgaatctgatccgtgcgaagagcatagaaaagggatgggatttgaaactgggagagctcgcccggatctggaagggtggttgcatcattcgtgcgattttcctcgatcggatcaagaaggcctatgacaggaatccagatctgtttagtctgttggttgatcctgaatttgcaaaggaaatgattgagagacagtcagcgtggcggcgagttgtgactcttgcgatcaacgctggtgtcagcgttccaggtatgtctgcaagtttggcgtactttgattcctatagaagggagagtttgcctgcaaacctggttcaggcacagcgagattatttcggtgctcacacctatgagaggattgatatgcctggtttcttccacactgagtggttcaagattgcaaaacaatcaaagatttgaaattttttagattgtcgaaccccagagagaataagcccatccatgctttaggtttaactgttaaattgcatagtgaattctgttggcaattcatagtttcttaagaaagttttccctatcaattgcttatgtgttttctgtactttttcaaattcaaagaaacaaagaacgtatcgaggtttttgaataaatccttgcttgaatttcaaagcagaaagctactaatctggtgtgttttactggattaagagatcaaattttagctatcttattttaaaaatgaatacagaggcaggctgcttatgttcaaattcgctattttgctgaccagaata

SEQ ID NO: 352 - protein, 483 aa, Pinus taeda
MASSDLSRIGLAGLAVMGQNLALNIAEKGFPISVYNRSSEKVDETVERAKVEGNLPVKGFHDPKDFVNSIQKPRVIILLVKAGLPVDKTIETLSAHMEEGDCIVDGGNEWYENTERRQEAAKQKGLLYLGMGVSGGEEGARHGPSLMPGGSFEAYKYIEDILLKVAAQVDSGPCVTYIGKGGAGNFVKMVHNGIEYGDMQLIAEAYDVLKSVGKLTNEELHQAFDNWNKGELCSFLVEITADIFGIKDDKGDGYLVDKVLDKTGMKGTGKWTVQQAADLSVAAPTIAASLDSRFLSGLKEERVEASKVFKNVDVGTVPDLDKTKLIDDVRRALYASKICSYAQGMNLIRAKSIEKGWDLKLGELARIWKGGCIIRAIFLDRIKKAYDRNPDLFSLLVDPEFAKEMIERQSAWRRVVTLAINAGVSVPGMSASLAYFDSYRRESLPANLVQAQRDYFGAHTYERIDMPGFFHTEWFKIAKQSKI

SEQ ID NO: 353 - DNA, 2003 bp, Populus trichocarpa
atggacgcctctactctttcacgcataggcctagccggtctagccgtgatgggtcagaacttagccctaaacattgctgaaaaaggtttcccaatttcagtctacaacagaaccacctccaaagtcgacgaaacccttcaccgtgcccaatccgaaggcccatttcctttaactggtcagtactcccctcgtgattttgttctctcaatccaacgccccagatccatcattatcttggtcaaagctggaaaccctgttgaccaaacgatttctgctttgaccgagttcatggagcctggtgatactatcatcgatggcgggaatgagtggtatcagaatactgagaggaggattcaagaagtgggagataaagggattctttatttgggtatgggggtttcgggtggagaagaaggtgcacgacatgggccttcgttgatgcctggtgggtctttggaggcgtataataatattgagtctgttttgaagagtgttgccgctcaagttgatgatgggccttgtgttacgtatattggtgaagggggttctggcaattttgttaaaatggttcataatgggattgagtatggagatatgcagttgatttcggaagcctatgatgttttgaagaatgttggtgggctttctaatggcgaattagctgagattttcggggagtggaatagaggggagttggagagttttttgattgagattacgagtgatatttttaaggttaaggatgatttggctgacggggatctggttgataagatattggataaaactggaatgaaagggactgggaaatggactgtccagcaagctgctgagttgtctgttgctgcgcctacaattgctgcttcgttggattgtaggtatttgagtgggttgaaggaggagagggagagtgcggccgagattttggaaaaagctggcttgaaggaggaaatggggagtgttaagagtgagattgacaagaagaggttgattgatgatgtgaggcaagcattgtatgcgtcgaagatttgcagttacgctcaggggatgaatttgttgaggtctaagagtgttgagaaagggtgggatttgaatttgggtgagttagctaggatttggaaaggtggatgcattattagggctgtgtttttggataggattaaaaaggcttaccagaggaatcctagcttggctagtttagttgtggacccggaatttgcgagggagatggtgcagaggcaggcggcatggaggagagtcgtggggctggcgatttcagctggtattagcactccagggatgtgtgctagtcttgcatattttgatacttacaggcgtgctaggctgccagcaaaccttgtccaggctcagagggacttgtttggggctcatacttatgagaggaccgatcgtccaggggcatttcatactgagtggacaaagcttgctcgtaagagcaatgctggttttggagctttcaattgagcatgttcatgagtcggttggctgtttgtttgtttgtttcaattggccgttggtaatgtttctctttgaactatggttgtatgtttccttgagaggattcgttgcagttattggttagcctcacagattttactgttaataagaaatgcatgcctcttgagttcagtaaattggtttttcatctgcagcaggcacgatagagttgagttctgccttttagattttgcttatttgctcctgaataatgtttcgacctcttgtgaggctatttgatttgaaactttgtaatttgcatactttacgtaagtatgtgtatgtccttctagaaataaacctgttcgaatgcatcttatgtgtttatgaaacaattctgatacaaatgtatcataggttacaaggttggttgcaatgtgaaaacgtggttgttgggcaggaatgttaacttcatcataagttcaagttagctgttgatttttttttttttttttgaagtcaatgaacacttgatgatttgttga

SEQ ID NO: 354 - protein, 494 aa, Populus trichocarpa
MDASTLSRIGLAGLAVMGQNLALNIAEKGFPISVYNRTTSKVDETLHRAQSEGPFPLTGQYSPRDFVLSIQRPRSIIILVKAGNPVDQTISALTEFMEPGDTIIDGGNEWYQNTERRIQEVGDKGILYLGMGVSGGEEGARHGPSLMPGGSLEAYNNIESVLKSVAAQVDDGPCVTYIGEGGSGNFVKMVHNGIEYGDMQLISEAYDVLKNVGGLSNGELAEIFGEWNRGELESFLIEITSDIFKVKDDLADGDLVDKILDKTGMKGTGKWTVQQAAELSVAAPTIAASLDCRYLSGLKEERESAAEILEKAGLKEEMGSVKSEIDKKRLIDDVRQALYASKICSYAQGMNLLRSKSVEKGWDLNLGELARIWKGGCIIRAVFLDRIKKAYQRNPSLASLVVDPEFAREMVQRQAAWRRVVGLAISAGISTPGMCASLAYFDTYRRARLPANLVQAQRDLFGAHTYERTDRPGAFHTEWTKLARKSNAGFGAFN

SEQ ID NO: 355 - DNA, 1458 bp, Populus trichocarpa
atggctcccctgaccagaattggcctagctggccttgctgtcatgggtcaaaatcttgccctcaatattgctgagaaaggatttcctatttctgtgtataatcggaccaccttaaaagttgatgagacagttgaacgagccaagcaggagggagatcttcccttatatggtttccatgatcctgaatcctttgttaagtcaatccaaaaacctcgtgtgataatcatacttgttaaggccggtgcccctgtcgaccaaaccatcaaaacactgtcagtttacatggagaaaggggattgtatcatagatggtggtaatgaatggtatgagaacactgagaggagggagaaagccttggctgaattaggtttgctttatcttggaatgggagtttcaggtggtgaagatggtgctcggcatggaccatctttaatgccaggtggttcctttgaggcctacaaacacatagaagatatccttcttaaggtggctgctcaagttcctgatagtggtccttgtgtcacttatattggcaaaggaggatctggcaattttgttaagatggttcacaatgggatagaatatggtgatatgcagctgattgcagaggcctatgatgttctgaaatcagttgggaagctcaccaacgaggaactatgccaggttttctctgaatggaacaagggggagctgctgagtttcttgattgagatcactgcagatatatttggaattaaggatgacaagggagaaggatatttggtcgacaaggtattggataaaactggcatgaagggtactggtaagtggacggttcagcaagctgctgagttgtcagttgctgctcccactatagcgtcatccttggatggaagattcctcagtggcctgaaggaagaaagagttgaagctgcaaaagtcttcaaatcaagcggcatcatagacatgctagctgaccaagtcgtggataaggaaaaattgatctatgatgtgagacaagcactatatgtgtccaaaatatgcagctatgcccagggtatgaacttgatacgtgcaaagagtgctgaaaagggatgggatttgaaactggggcagttaacaaggatttggaagggtggttgcattatccgtgctgtcttcttggaccgtattaagaaggcttatgatagaaacccaaacctgcctaatcttcttgtggatccagaatttgcaaaagaaattattgagagacaatctgcttggagaagagttgtatccattgctatcaactctggtatcagcacccctggtatgtcttctagccttgcgtattttgacacatacaggaggtccaggctgcctgctaatttagtccaagctcaacgagattattttggagcacatacatatgagaggattgatatagatggatccttccatactgagtggtttaaaattgctaaacagtcaaagatctaa

SEQ ID NO: 356 - protein, 485 aa, Populus trichocarpa
MAPLTRIGLAGLAVMGQNLALNIAEKGFPISVYNRTTLKVDETVERAKQEGDLPLYGFHDPESFVKSIQKPRVIIILVKAGAPVDQTIKTLSVYMEKGDCIIDGGNEWYENTERREKALAELGLLYLGMGVSGGEDGARHGPSLMPGGSFEAYKHIEDILLKVAAQVPDSGPCVTYIGKGGSGNFVKMVHNGIEYGDMQLIAEAYDVLKSVGKLTNEELCQVFSEWNKGELLSFLIEITADIFGIKDDKGEGYLVDKVLDKTGMKGTGKWTVQQAAELSVAAPTIASSLDGRFLSGLKEERVEAAKVFKSSGIIDMLADQVVDKEKLIYDVRQALYVSKICSYAQGMNLIRAKSAEKGWDLKLGQLTRIWKGGCIIRAVFLDRIKKAYDRNPNLPNLLVDPEFAKEIIERQSAWRRVVSIAINSGISTPGMSSSLAYFDTYRRSRLPANLVQAQRDYFGAHTYERIDIDGSFHTEWFKIAKQSKI

SEQ ID NO: 357 - DNA, 1479 bp, Populus trichocarpa
atggacgcctctactctttcacgcataggcctagcaggtctagccgtgatgggtcaaaacttagccctaaacattgccgaaaaaggttttccaatctcagtctataaccgaacaacttccaaagtcgacgaaactcttatccgtgctcaatccgaaggcccattctccctaactggtcactactctcctcgtgattttgttctctcaatccaaaggcctagatccatcatcatcttggtcaaagctggaaacccagttgaccaaacgatctctgctctgaccgagttcatggagcctggtgacactatcatcgatggtgggaatgagtggtaccagaatactgagaggagaattcaacaggtggcagataaagggattctttatttgggcatgggggtttccggtggcgaagaaggtgcaagacacgggccttcgttgatgcctggtggttcttttgaggcgtataagaatattgagtctgtcttgaagagtgttgcagctcaagttgatgacggtccttgtgttacttatattggcgaagggggttctggaaattttgttaaaatggttcataatgggattgagtatggagatatgcagttgatatcggaagcttatgatgttttgaagaatgttggtgggctttcgaatagcgaactggcggaaatttttggggagtggaatagaggggagttggagagtttcttgattgagattacgagtgatatttttaaggtcaaggataatttggttgatggggatttggttgataagatattggataagactggaatgaaagggacagggaaatggactgttcagcaagctgctgaattgtctgttgctgcaccgacgattgctgcttcgttggattgtagatatttgagtggtttgaaagaggagagggagagtgcggcggagattttgaaggaagctgggttggaggaggaagtggggagtgttaagagtggggttgataagaagaggttgattgatgatgtgaggaaagcattgtatgcatccaagatttgtagttatgctcaagggatgaacttgttgagggctaagagtgttgagaaaggttgggatttggattttggtgagctagctaggatttggaaaggtgggtgcattattagggctgtgtttttggataggattaaaaaggcttaccagaggaatcctaacttggcaagtttagttgtcgacccggagtttgccagggagatggtgcagaggcaggcggcttggaggagagttgtggggttggcgatttcagctggaattagcactccgggaatgtgtgccagtcttgcttattttgatacttataggcgtgctaggctgccagcaaatcttgttcaggctcagagagacttgtttggggcccatacttatgagaggactgatcgtccaggggcatttcatactgagtggacaaaacttgctcgcaagagcagtgctggtgctttcagttaa

SEQ ID NO: 358 - protein, 492 aa, Populus trichocarpa
MDASTLSRIGLAGLAVMGQNLALNIAEKGFPISVYNRTTSKVDETLIRAQSEGPFSLTGHYSPRDFVLSIQRPRSIIILVKAGNPVDQTISALTEFMEPGDTIIDGGNEWYQNTERRIQQVADKGILYLGMGVSGGEEGARHGPSLMPGGSFEAYKNIESVLKSVAAQVDDGPCVTYIGEGGSGNFVKMVHNGIEYGDMQLISEAYDVLKNVGGLSNSELAEIFGEWNRGELESFLIEITSDIFKVKDNLVDGDLVDKILDKTGMKGTGKWTVQQAAELSVAAPTIAASLDCRYLSGLKEERESAAEILKEAGLEEEVGSVKSGVDKKRLIDDVRKALYASKICSYAQGMNLLRAKSVEKGWDLDFGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERTDRPGAFHTEWTKLARKSSAGAFS

SEQ ID NO: 359 - DNA, 2061 bp, Populus trichocarpa
gaaaggcaacggtcacatttagaccacctcccagttcttacctaccaatgccaagtaccaaccaaaatagaatactattttggtggccaaatttgacccgcttataaatccggacaaacgaagagatcatcaccaattgttattgtttccttctaactagtccctttcttcctgactgatctgtgcactatctttgattttcctgggttttcctttgtttctccagaatccatttccaagggtaactatggctgcacctcccaagccaacaagaataggccttgctggtctggctgtcatgggccagaatctggcccttaatatcgcagagaaaggtttccccatttctgtttataatcggactacctccaaagttgatgagactgttgtgagggctaaaaaagagggagatcttcccttatatggcttccatgatcctgaatcttttgtgaagtcaatccaaaagcctcgagtggtaattatgcttgttaaggcagggtcacctgttgaccaaaccataaagactctttctgcctacttggagaagggtgattgtatcattgatggtggaaatgagtggtatgagaacactgagaggagagaaaaggctatggctgaactgggcttgctctaccttggaatgggagtttcaggtggtgaagagggtgcacgtaatgggccttctatgatgcctggaggttcctttgaggctttcaagtacattgaagacattctgcttaaagtagcagctcaagttcctgatagtggcccctgtgtgacttacattggcaaaggtggttctggtaattttgtcaagatggttcataatggaattgaatatggtgatatgcagttgattgctgaagcatatgatgtactaaaatcagttggaaagttgtcgaatgatgaactccgtagtgttttttcagaatggaacaagggtgagcttctgagcttcttggttgaaatcactgcagatatatttggaattaaagatgataagggagaaggatattttgttgacaaggttttggacaaaactggcatgaagggtaccggtaagtggaccgtgcagcaagctgctgatctatcagttgcagctcctacaattgcctcttctttggatgcaaggttcctaagtggtttaaaggaggaacgagttgaagctgctaaagtcttcaaagcaggtggctttggggatattttgactgatcaagtggtggataagaagcagttgatcgatgatgtcaggcaagctctttatgcatccaagatttgtagctatgcacaggggatgaatttgatccgtgcaaagagtatggagaagggatgggacttggaattgggagaactggctaggatttggaagggtggttgtattattcgagcagtatttctggacagaatcaagaaggcatatgataggaatcctgatcttgccaaccttctagtggatccagagtttgcaaaggaaatcattgagcgccagtcagcctggcgcagggttgtatgtcttgcaatcaactcaggtattagcactcctggtatgtcatccagtctggcttattttgacactttccgaagggaaaggttgccagctaatttggtccaagctcaacgagattattttggtgctcatacatatgaaagggttgatgtggaaggatctttccatactgaatggttcaagattgcaaggcagttgaagaattaaaccttttcctggtgctatcaagcttaattaagactttcaataagacaataacttctgctctggactctattctgggtagaacttacatcacccctatttcatgaaatttatctcaatcaggttcatcaaatccaattgagtacttagactttgtctcacttttatatgttgtggtttttcttggcagttctgcttttgtattttattttcaccggactcctcatccaggattgtagccccatttctttttaaagagatatttaatggtgcttttgagtagtagtatgaaatcagatgtttgaacaataaattttctcttttggtgttattttctttatttgctcttc

SEQ ID NO: 360 - protein, 488 aa, Populus trichocarpa
MAAPPKPTRIGLAGLAVMGQNLALNIAEKGFPISVYNRTTSKVDETVVRAKKEGDLPLYGFHDPESFVKSIQKPRVVIMLVKAGSPVDQTIKTLSAYLEKGDCIIDGGNEWYENTERREKAMAELGLLYLGMGVSGGEEGARNGPSMMPGGSFEAFKYIEDILLKVAAQVPDSGPCVTYIGKGGSGNFVKMVHNGIEYGDMQLIAEAYDVLKSVGKLSNDELRSVFSEWNKGELLSFLVEITADIFGIKDDKGEGYFVDKVLDKTGMKGTGKWTVQQAADLSVAAPTIASSLDARFLSGLKEERVEAAKVFKAGGFGDILTDQVVDKKQLIDDVRQALYASKICSYAQGMNLIRAKSMEKGWDLELGELARIWKGGCIIRAVFLDRIKKAYDRNPDLANLLVDPEFAKEIIERQSAWRRVVCLAINSGISTPGMSSSLAYFDTFRRERLPANLVQAQRDYFGAHTYERVDVEGSFHTEWFKIARQLKN

SEQ ID NO: 361 - DNA, 1518 bp, Phaeodactylum tricornutum
atgccagtatcacaaaccgttcctcaaatttcaattccagatgacgaactttgtgacattggaatctttggtcagtctgtgatgggagcaaatcttagtcttaatatcgccgagagtggatttcgtgttgttgtgggcaatcgtactcagaagaaggttgaggcgacggtacagcgtgccaaggacgaaggaaacttgccgcttgttggctccgatggtcctgagcattttgtttcgcagttaaaaaagcctcgcaaggtcatcatccttgtacaagcgggaacggctgtcgatgatacaatatcgtcacttgcaaagtacttggagcctggagacatcttaattgacggaggcaacgagtggttccctaacagtattcgtcgtggagagtttctggagccgaagaacatccattttctcggaatgggcattagtggaggagaagaaggagcacgcaaaggtccatctttaatgccgggcggaccgaaagatgcgtacgatcttgtcgaacccatcttgtcaaaatgcgctgcttacgtcgatgaggccggatcatgcgttggctacgtaggcccaattggagcagggaactacgtcaagatggttcataacggcattgaatacggagacatgcaattaatcgcggaagtctatgacacgatgaaaagtacgctgggtatgtccaatttggaaatagccgatgtcttcgacgaatggaataaaagtgaattggaatcttatttgatcgaaatcaccgccacgattctccgcaaaaaggatgatgagactggttgtgggtacgtaatcgattatattttggacaaaactggcatgaagggcactggaaggtggaccattcaggaaggagctgaaagaggtgttgcaatttctactttggctgccgctctcgacgctcgaatgctgagcggattgaaggaggaacgagaagtggcgtccaaggtacttgatgagccatcaatgcagagtacagataagacacaggtagttgcggatctacgagcagcactgtacgcgtcgaaagtttgttcatacgcccaaggattgagtttgatcaaagcagcttccgatgagtatcagtgggacgtggacctttcggaatgtgcccgcttgtggatgggaggatgcatcattcgagcaaagttgttggggtcaattcgagaagcttattcgaaaaattccaatttgtcgaatttgcttgttgatgccggcttcgcgtcggctttgaatgagcgctcagttgcctggagaagacttatcgctctctgtgtaacgagcggtgtcacgtgttcggctctctgcaattcgttaagttactttgatacgtacagacgagctcgcctcccggccaacttaactcaggctcagcgggattttttcggagggcacacatatgagcgtacagataaagatggtcgttttcataccgcgtggacggacgctcacaaagacataggcgatgccagtcaacgaacaagcggagaaaatgttcaaatttaa

SEQ ID NO: 362 - protein, 505 aa, Phaeodactylum tricornutum
MPVSQTVPQISIPDDELCDIGIFGQSVMGANLSLNIAESGFRVVVGNRTQKKVEATVQRAKDEGNLPLVGSDGPEHFVSQLKKPRKVIILVQAGTAVDDTISSLAKYLEPGDILIDGGNEWFPNSIRRGEFLEPKNIHFLGMGISGGEEGARKGPSLMPGGPKDAYDLVEPILSKCAAYVDEAGSCVGYVGPIGAGNYVKMVHNGIEYGDMQLIAEVYDTMKSTLGMSNLEIADVFDEWNKSELESYLIEITATILRKKDDETGCGYVIDYILDKTGMKGTGRWTIQEGAERGVAISTLAAALDARMLSGLKEEREVASKVLDEPSMQSTDKTQVVADLRAALYASKVCSYAQGLSLIKAASDEYQWDVDLSECARLWMGGCIIRAKLLGSIREAYSKNSNLSNLLVDAGFASALNERSVAWRRLIALCVTSGVTCSALCNSLSYFDTYRRARLPANLTQAQRDFFGGHTYERTDKDGRFHTAWTDAHKDIGDASQRTSGENVQI

SEQ ID NO: 363 - DNA, 1667 bp, Phaeodactylum tricornutum
cataaaacggccatcgcaactgctgttcacgagaactgttgcaatcgcgaagcaatcgcaaaagaatctattcaaacactttccaccaacgagataaacaggatgagctgcgatattggtctttacggtcttgctgtcatgggacagaattttgcgctcaatatggcgtcgcacgggttcaccgttgccgtttgcaaccgctcgccctccaaagtcgatacgacggtccaacgcgccaaggacgaaggcgatttgcccttgatcggtaccaaatctcccgaagaatttatttccaaactcagcaagcctcggaaagtcgtcattctcgtccaagccggaaaacctgtcgatttgaccatcgaagcgatcagcgaattcatggaagaaggggatgtcattattgacggaggcaacgaatggttcccgaatcagattcgtcgtcacgaagaattggaaaagaagggtatcatgttcatcggcatgggaatttctggtggcgaagaaggagcccgcaacggaccttctctcatgcctggcggtccccgaaaggcgtacgacttgattgaacccatcatcatgaagtgtgccgccaaggctggggatccggaagaaccctgcacgggttattgcggaccaatcggagcgggcaattacgtcaaaatggtgcacaacggtatcgaatacggcgacatgcagttgattggagaggtctacgatattctaaagaatattgtcggtatgggcaacgatgaaatggccacactctttgaagactggaactctggtgatctcgagtcgtacctcattgaaatcacggccaagattttggctcgcaaggacgatttgaccgacgacggatacgtggtggacaagattcttgacaagacaggaatgaaaggtactggccgttggacggtacaagaagctgccgaacagagtgttgcagcccctctcattgcagcttccctcgatagtcgctacatttccggccgcaaggaagaacgtgtcgctgccagcaaagtcctccagggaccatccaacgaaatgccgcaagtcgacaaggatcaaatcttgtcggatctgcagcaagcgttgtactgcgccaaggtaacttcgtatgcgcagggaatgggaatcatccaggccgcgtccgacaagaacgagtgggacgtcgacctctccctctgtgccaaaatgtggcgtggaggctgcatcattcgcgcgagcttgttgagcaagatcacggccgcctttgaaaagaacaaggacttgcagaatttgttggtggacgaaacgtttgctgaagaaatcaacgcaaggcagatggcttggcgccgcgtggtttctttgggcgtcgctagcggtatcgctaccccggccttgtccgctgctctttcctactttgaccagtaccgtcgtgatcgcttgccggccaacctgattcaagcgcagcgcgatttctttggcggacacacttacaatcgtgtcgatcgtgatggcacttttcattgcttgtgggacgaaacgcacaaggatattggtgatttgacgggccgcaccgcgggtgagctctagacgccacggatcccgagtcgcgttaacgtatatcaaatctaagtattggtaaatcacaaacttcgtcagcaatagcgagtcattttaatatc

SEQ ID NO: 364 - protein, 490 aa, Phaeodactylum tricornutum
MSCDIGLYGLAVMGQNFALNMASHGFTVAVCNRSPSKVDTTVQRAKDEGDLPLIGTKSPEEFISKLSKPRKVVILVQAGKPVDLTIEAISEFMEEGDVIIDGGNEWFPNQIRRHEELEKKGIMFIGMGISGGEEGARNGPSLMPGGPRKAYDLIEPIIMKCAAKAGDPEEPCTGYCGPIGAGNYVKMVHNGIEYGDMQLIGEVYDILKNIVGMGNDEMATLFEDWNSGDLESYLIEITAKILARKDDLTDDGYVVDKILDKTGMKGTGRWTVQEAAEQSVAAPLIAASLDSRYISGRKEERVAASKVLQGPSNEMPQVDKDQILSDLQQALYCAKVTSYAQGMGIIQAASDKNEWDVDLSLCAKMWRGGCIIRASLLSKITAAFEKNKDLQNLLVDETFAEEINARQMAWRRVVSLGVASGIATPALSAALSYFDQYRRDRLPANLIQAQRDFFGGHTYNRVDRDGTFHCLWDETHKDIGDLTGRTAGEL

SEQ ID NO: 365 - DNA, 1700 bp, Phaseolus vulgaris
ttttgctgtgattcggttgaaatttcaggaggacaattatggctctacccacaacgagaataggcctggctggactggctgttatgggccaaaatctagcactcaatattgctgagaaaggctttcctatttctgtttataaccgaactacatccaaggttgatgagactgtagaacgagcaaaactagaaggaaatcttccagtttatggctaccatgatcctaaagcttttgttctttccattcgaaagcctagggtggtaataatgcttgttaaggctggggcacctgttgaccaaaccattaagaccctgtctgccttcatggaaaaaggtgactgtataattgatggtggtaatgaatggtatgagaacactgaaagaagagaggaagcaatgtctgaattgggttttctctaccttggtatgggagtttctgggggtgaggaaggtgctcgtaatggtccctctttgatgcctggtggttcgtttgaagctttcaaaaacatagaagatattcttctcaaggtggcagctcaagtccctgatagtggtccttgcgtgacatatattggtaaaggtggttctggtaattttgtgaagatgattcacaatggtatagaatatggtgatatgcagctgattgcagaggcttatgatgtgctgaagtcagttggaaagttgtcaaatgaggaactacaaagtgtcttctcagaatggaacaaaggagaacttcttagtttcctgattgaaatcaccgcagatatatttggaattaaggatgataaaggagaaggatatcttgttgacaaggttctagacaagactggcatgaagggtactggtaagtggactgttcagcaagctgctgaattatcagttgctgctcccactattgaagcatcattggatgcaaaggttctgagtggcttgaaggaggaaagagtagaagctgcaaaagtctttaaatcaggtgatattgtgactgatcaacctgtagacaagcagcagttgattgatgatgttaggaaggctctttatgcagccaaaatctgtagttatgcacagggaatgaatctgatccgtgcaaagagtatcgaaaagggatgggatttgcagttgggtgaactggcccgaatttggaaagggggttgcatcattagagctatattcttagacagaattaagcaggcatatgatagaaaccctagtctggcaaaccttcttgttgatccagagtttgcgaaggaaatactcgatcgccaatctgcctggaggagagttgtttgccttgctgtcaattctagaatcagcactccaggtatgtctgctagccttaattattttgacagttacagcagggaaagttcgcctgctaatttggtgcaagctcagcgtgactactttggtgctcatacatatgaaagggttgacatagagggctcttaccatactgagtggttcaagcttgccaaacagtcaagaatttagatcactttctttgagcccatcaggatttcaaataaatgtaatgttttctgctcagactgtgtgctgagttgagtttacatagccactatgtggtgaagtgttattatattgtttccaactgaattgcttgatgttccattctccaaaaaaaatgttgtatctttgcggatagtgttttgtgcttgatacaaaattggccccagttcgtgc

SEQ ID NO: 366 - protein, 483 aa, Phaseolus vulgaris
MALPTTRIGLAGLAVMGQNLALNIAEKGFPISVYNRTTSKVDETVERAKLEGNLPVYGYHDPKAFVLSIRKPRVVIMLVKAGAPVDQTIKTLSAFMEKGDCIIDGGNEWYENTERREEAMSELGFLYLGMGVSGGEEGARNGPSLMPGGSFEAFKNIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGEGYLVDKVLDKTGMKGTGKWTVQQAAELSVAAPTIEASLDAKVLSGLKEERVEAAKVFKSGDIVTDQPVDKQQLIDDVRKALYAAKICSYAQGMNLIRAKSIEKGWDLQLGELARIWKGGCIIRAIFLDRIKQAYDRNPSLANLLVDPEFAKEILDRQSAWRRVVCLAVNSRISTPGMSASLNYFDSYSRESSPANLVQAQRDYFGAHTYERVDIEGSYHTEWFKLAKQSRI

SEQ ID NO: 367 - DNA, 1959 bp, Sorghum bicolor
gcacgaggcccgatcgattggagatagatatttaagccggggtggggagggagggaaggtggcgagtgaaagggaggtaggtggacggtggtggtggcatcgccaattcaactccgcatctgatctgcatccgcatcggcaccagcgcgattcacaccgcccagcgaccaggcgggagaggaggcagcaccagagtgtaggagatggcgctcacaagaattggtcttgctggccttgcggtcatggggcagaaccttgccctcaacattgcagagaaaggcttccccatctctgtctacaacaggacaacctccaaggttgatgagaccgtgcagcgtgccaaggcagaaggaaaccttcctgtgtacggcttccatgaccctgcatcctttgtgaactccattcagaagccgcgtgttgtcatcatgcttgtcaaggctggtgcaccagttgaccagaccattgcgacgctcgcagctcacttggagcagggtgactgtatcattgatggagggaatgagtggtatgagaacactgagaggagggagaaggccatggaggagcgtggcctcctctatcttggaatgggcgtctctggaggagaggagggtgcccgcaacggaccatccttgatgcctggaggctcatttgaggcttacaagtacattgaagacattgttctcaaggtggctgctcaggtccctgacagtggcccatgtgtcacgtatattggcaaaggtggatcaggcaactttgtcaagatggttcacaatggtattgagtatggtgatatgcagctgatttcggaggcatatgatgtgctcaagtcagtcggtaagctcaccaacagtgagctgcaccaggtgttctccgaatggaacaagggtgagctccttagtttcttgattgagatcacggctgacatatttggcatcaaggacgagcagggtgagggctacttggttgacaaagtcctggacaagaccgggatgaaaggaacagggaaatggacagtgcagcaggctgctgagctatctgtggctgctcctacaattgaggcatccttggactccaggttcctgagcggactgaaggatgagcgggtcgaggcttccaaaatcttccaaggggactactccactggcctaccagtcgacaaggcacagctgatcgaagatgtgaggcaggccctctatgcctccaagatctgcagctacgcacagggcatgaacatcatcaaggctaagagctcagagaaaggatggggtctcaaccttggcgagctagccaggatctggaagggtgggtgcatcatccgcgccatcttcctcgaccgcatcaagaaggcctatgataggaactctaacctcgccaacctcctcgtggaccctgagtttgcacaggagatcatggacaggcaagcggcatggcgtagggtggtctgccttgccatcaacaatggcgtcagcaccccaggcatgtccgctagcctggcctacttcgactcgtaccggagggacaggctgcctgccaacctggtgcaggcccagagggactacttcggggctcacacctacgagagggttgacatgcctggcgctttccacaccgagtggttcaagattgcgcgcaacatctccaagaactgagctgctccagatgggcatgccatggcagcacattgacatggttctcctattttcgtcatcttttattgctgctcagtgttgagcaatcggtaatgtactactttgtagggggaggtactgtggttaaatttgatttttcgcgctcagtgcttaatttgggtcaggaagttgaatttgtctctgttcttcccttgtaagcggttggaatggagaacaatgatgtttcttggaacttctccatttgatctttgtaagttcgttatcagaataaataaaagcattctgacatgcttctgcttgtccaaaaaaa

SEQ ID NO: 368 - protein, 481 aa, Sorghum bicolor
MALTRIGLAGLAVMGQNLALNIAEKGFPISVYNRTTSKVDETVQRAKAEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDIVLKVAAQVPDSGPCVTYIGKGGSGNFVKMVHNGIEYGDMQLISEAYDVLKSVGKLTNSELHQVFSEWNKGELLSFLIEITADIFGIKDEQGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNSNLANLLVDPEFAQEIMDRQAAWRRVVCLAINNGVSTPGMSASLAYFDSYRRDRLPANLVQAQRDYFGAHTYERVDMPGAFHTEWFKIARNISKN

SEQ ID NO: 369 - DNA, 1479 bp, Saccharomyces cerevisiae
atgtcaaaggcagtaggtgatttaggcttagttggtttagccgtgatgggtcaaaatttgatcttaaacgcagcggatcacggatttaccgtggttgcttataataggacgcaatcaaaggtagataggtttctagctaatgaggcaaaaggaaaatcaataattggtgcaacttcaattgaggacttggttgcgaaactaaagaaacctagaaagattatgcttttaatcaaagccggtgctccggtcgacactttaataaaggaacttgtaccacatcttgataaaggcgacattattatcgacggtggtaactcacatttcccggacactaacagacgctacgaagagctaacaaagcaaggaattctttttgtgggctctggtgtctcaggcggtgaagatggtgcacgttttggtccatctttaatgcctggtgggtcagcagaagcatggccgcacatcaagaacatctttcaatctattgccgccaaatcaaacggtgagccatgctgcgaatgggtggggcctgccggttctggtcactatgtgaagatggtacacaacggtatcgagtacggtgatatgcagttgatttgcgaggcttacgatatcatgaaacgaattggccggtttacggataaagagatcagtgaagtatttgacaagtggaacactggagttttggattctttcttgattgaaatcacgagggacattttaaaattcgatgacgtcgacggtaagccattggtggaaaaaattatggatactgccggtcaaaagggtactggtaaatggactgcaatcaacgccttggatttaggaatgccagtcactttaattggggaggctgttttcgctcgttgtttgtcagccataaaggacgaacgtaaaagagcttcgaaacttctggcaggaccaacagtaccaaaggatgcaatacatgatagagaacaatttgtgtatgatttggaacaagcattatacgcttcaaagattatttcatatgctcaaggtttcatgctgatccgcgaagctgccagatcatacggctggaaattaaacaacccagctattgctctaatgtggagaggtggctgtataatcagatctgtgttcttagctgagattacgaaggcttatagggacgatccagatttggaaaatttattattcaacgagttcttcgcttctgcagttactaaggcccaatccggttggagaagaactattgcccttgctgctacttacggtattccaactccagctttctctactgctttagcgttttacgacggctatagatctgagaggctaccagcaaacttgttacaagcgcaacgtgattattttggcgctcatacatttagaattttacctgaatgtgcttctgcccatttgccagtagacaaggatattcatatcaattggactgggcacggaggtaatatatcttcctcaacctaccaagcttaa

SEQ ID NO: 370 - protein, 492 aa, Saccharomyces cerevisiae
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGNISSSTYQA

SEQ ID NO: 371 - DNA, 1932 bp, Solanum lycopersicum
ggaaaagttaggctaacatcgactaagacgccaacctctcgttggttgttttggccactaccctttcactccctcgacgagtccgtcactctcctattacctaaaaacccaccaaacatttctcatttttcactatatattcatcttcttcactccattttcaaggaatctcttccatttttttcctcctgaaaatcactttttcttcattcaccatggaaggcgcagcaacagctcaagctttatctcgtattgggttagctggcttagctgttatgggtcagaatttggccttaaacatagctgaaaaagggtttcctatatctgtttacaatagaaccacttcgaaagtagatgaaaccctagatcgtgctcagaatgaaggacagcttccattgattggacagtacaatcctcgtgatttcgtgttgtctattcaacgacccagatctgttatcattcttgttaaagcggggtcacctgttgatcaaacgattgctgcgctttctgagtatatggagcctggggatacgattattgatgggggtaatgagtggtatgagaatactgaaaggaggattgatgaggcgtcgtctaaggggcttttgtatttgggtatgggtgtttctggtggagaagaaggggcgaggaatggaccttcgcttatgcctggtgggtcttatggggcttatacgaatatcaaagatattcttgagaaggttgcagctcaagttgaggatgggccttgtgttacttatattggtgaaggtgggtcggggaattttgtgaaaatggtgcataatggaattgaatatggtgatatgcagttgatttcggaagcttatgatgtgttgaagaatgcgggtgggttgagtaattctgaattggctgatattttcgccgaatggaaccgtggggaattggagagctttttgattgaaattacagcggatatattcaatgtgaaggatgaattgactggaaatggggagttagtggacaagattttggataagacaggaatgaaggggacggggaaatggactgtgcagcaggcggcggagctgtctattgcagctccgacaattgctgcttcgttagacagtaggtacatgagtggattgaaggatgagagggtagaagcctcagagatttttaggaaggaaggtttaaaggaggaaataagttctgatattaatggtattagcagtgttgataagaagagattgattgatgatgtgaggcaggcattgtatgcgtcgaaaatctgtagttatgctcaggggatgaatttgctaagggcaaagagctctgagaaaggttggaatttgaatttgggagagatggctaggatttggaaaggtggttgtattatcagggcagtgtttttggatcgtattaagaaggcgtatcagaggaatcctaatttggctaacttgatggttgacacggagttcgcaagggagatggtgcagaggcaagctgcttggaggagagtggtgggacttgctgttcagaagggaattagtgttcctggaatgtctgctagtcttcagtatttcgacacctacaggcgttctaggcttcccgcgaaccttgtgcaggctcagagggactatttcggggcacatacttatgagagagttgacaagccaggagcataccataccgagtgggcaaaacttgctaggaaagctcgagtgtaatgctgctgcagctattgcggattatgatcaaaatctctggtattagtcgcgctttagtacttttttcgtttagttttgcagttaataatgttgtatgcctttgaacattatagggccttcgctatcgaaatgacttcttccattgaagtaaaagaagttgcttttcctacattacattttgatgcatacaaattacctgcacttttatttatatatatggattatc

SEQ ID NO: 372 - protein, 496 aa, Solanum lycopersicum
MEGAATAQALSRIGLAGLAVMGQNLALNIAEKGFPISVYNRTTSKVDETLDRAQNEGQLPLIGQYNPRDFVLSIQRPRSVIILVKAGSPVDQTIAALSEYMEPGDTIIDGGNEWYENTERRIDEASSKGLLYLGMGVSGGEEGARNGPSLMPGGSYGAYTNIKDILEKVAAQVEDGPCVTYIGEGGSGNFVKMVHNGIEYGDMQLISEAYDVLKNAGGLSNSELADIFAEWNRGELESFLIEITADIFNVKDELTGNGELVDKILDKTGMKGTGKWTVQQAAELSIAAPTIAASLDSRYMSGLKDERVEASEIFRKEGLKEEISSDINGISSVDKKRLIDDVRQALYASKICSYAQGMNLLRAKSSEKGWNLNLGEMARIWKGGCIIRAVFLDRIKKAYQRNPNLANLMVDTEFAREMVQRQAAWRRVVGLAVQKGISVPGMSASLQYFDTYRRSRLPANLVQAQRDYFGAHTYERVDKPGAYHTEWAKLARKARV

SEQ ID NO: 373 - DNA, 2054 bp, Spinacia oleracea
gcacgagcaaaaaccctccgcaaaccccccatttccctccctcctcgttgcagcacgacagtcgacaccatctctttctctctcctccttcaacaatggcggctgttcgctctgcaattctgaaatacatgagggtgccagtagcccaaaacacttactctccatcttcgatttcatcttccatcaactccttcttctctcgccgcaacttttccgatgaggtccgaggttccttcctcgacgagtccgtcctttctctctcctccatttatacatcttccccttctttctctctcctcaccaactccccttccacactcttcctcctccactttctctctcttctcaacaatggcggcttctcaaatcggtctcgtcggcctcgccgtaatgggccaaaacctcgccctcaacatcgccgagaaaggcttccctatttccgtctacaatcgcacagcctccaaggtcgatgaaaccctagaccgcgccaagtcagaaggcgatctcccgctctctggccactacactcctcgcgatttcgtcctctccatagaacgccccagatccatcgttatcctcgtcaaagccggctcccccgttgatcaaactatcgcttctcttgcctcctttatggaacctggtgacactatcatcgacggaggtaacgagtggtaccaaaacacagagcgtcgtttatctgacgctcactccaacggcctcctctacctcggtatgggcgtctctggtggcgaagaaggcgctcgttttggcccctcgctcatgcccggcggagatttccaggcgtacgacaatatccaacacattttgaagaaggttgctgctcaagtcgatgatgggccttgtgttacatacatcggagaaggtgggtccgggaatttcgtgaagatggtgcacaatgggattgagtatggtgatatgcagctgatttcggaggcttatgatgtgttgaagaatgtgggtggattgagcaatgaggaattgggtcagatttttgatgagtggaataagagtgagcttgagagctttttggttgagattactgcggatatctttaaggtgaaggatgatttagcggatggaggtttggttgataagattttggataagactgggatgaaaggtactggcaaatggactgttcaacaagctgctgaactctctgttgctgctcctaccattgctgcttctttggattgcaggtatctaagtgggttgaaagaggagagagaaaatgcagccaagatattggaagctgcagggatgaaggaagaggttaatgcgattagaggtggggttgataagaagaggttgattgatgatgtgaggcaagcgttgtatgcttcaaagatctgtagttatgctcaagggatgaatttattgagggcgaagagtgctgagatgggttgggatttgaatttaggggagttggcgaggatttggaaaggtgggtgtattattagggcagttttcttggacagcattaagcaggcatatcagaggaaccccaacttagctagtttggtggttgatcctgagtttgctaaggagatggtacagaggcaagcagcttggagaagggttgtgggtttggcagtctctgctgggataagtacacctggaatgtgcgccagtcttgcttatttcgatacttacaggcgtgccagacttccagctaaccttgttcaagctcagagggactactttggcgctcatacctatgagagggttgatctccctggctcttaccacactgagtggtcgaagcttgctcgtaagagtgaccccaatgttgctgctgccctccactgagctacgcctttttcccttcccctgtgttttcttaccatgtatttctgttgtttccaattgaaattgggattttgtgcctccaacaatgatccctttttaggcataggaattgttacagtattgttttagctcattagaaatggtagcgggaactgatgttaataagagcatgtctttcggaatatcaatacaaagaggtgttgtgtgaactaaatctcgtgccg

SEQ ID NO: 374 - protein, 537 aa, Spinacia oleracea
MRSEVPSSTSPSFLSPPFIHLPLLSLSSPTPLPHSSSSTFSLFSTMAASQIGLVGLAVMGQNLALNIAEKGFPISVYNRTASKVDETLDRAKSEGDLPLSGHYTPRDFVLSIERPRSIVILVKAGSPVDQTIASLASFMEPGDTIIDGGNEWYQNTERRLSDAHSNGLLYLGMGVSGGEEGARFGPSLMPGGDFQAYDNIQHILKKVAAQVDDGPCVTYIGEGGSGNFVKMVHNGIEYGDMQLISEAYDVLKNVGGLSNEELGQIFDEWNKSELESFLVEITADIFKVKDDLADGGLVDKILDKTGMKGTGKWTVQQAAELSVAAPTIAASLDCRYLSGLKEERENAAKILEAAGMKEEVNAIRGGVDKKRLIDDVRQALYASKICSYAQGMNLLRAKSAEMGWDLNLGELARIWKGGCIIRAVFLDSIKQAYQRNPNLASLVVDPEFAKEMVQRQAAWRRVVGLAVSAGISTPGMCASLAYFDTYRRARLPANLVQAQRDYFGAHTYERVDLPGSYHTEWSKLARKSDPNVAAALH

SEQ ID NO: 375 - DNA, 1643 bp, Spinacia oleracea
ggcacgagattgaacccacatcgttaaattttctgggttttcatttgatttctgatcaaccaattttccgagcaggaataagcaatggctcctcctacaaggattggtcttgctggtctggctgtgatgggtcaaaatcttgcactaaacattgctgaaaaaggattccccatttctgtttacaaccgtacaacctcaaaggttgatgagaccgttgaacgagctaaacaagaaggaaatcttcctctgtatgggtttcatgaccctgaatcctttgtgaattcaatccagaaaccccgtgtcataatcatgcttgttaaggctggggctccagttgatgcaaccatcaaaactttgtctgcctatttggagaaaggagactgcatcatcgatggtggcaatgagtggtatgagaataccgagaggagagagaaagcaatggaggaaaagggactgctctacctcggaatgggagtttcaggaggtgaagagggtgcaagaaatggaccctctatgatgcctggtggttcattcgatgcttacaaaaacatcgaggatattctaaccaaggttgccgcacaggttgatagtggcccttgtgtaacctatattggcaaaggaggttctggcaattttgttaaaatgattcacaacggaattgaatatggtgacatgcagttgattgcagaggcttatgatgtgctgaaatcagttggaaagctctctaatgaagagttgaaggaagtttttgcagagtggaacagaggagagcttcttagcttcttgattgaaatcacagcagatatttttggaattaaggatgacaaaggtgaaggatatttggtagacaaagtgttggataaaaccggtatgaagggtacaggaaaatggacagttcaacaagctgctgagttatctgttgctgcccctaccattgcatcatctttggactcgagatttctgagcggtctaaaagatgaaagagttgaagctgccaaggtgttcaaagctggaggggttgaggatacactctctgaccaagttgttgataaaaagaaattgatagatgatgttagacaagccctttatgctgcgaaaatatgtagctatgcacaaggaatgaacttgattcgtgcaaaaagtgttgagaaagagtgggatttgaaactcggggagctagctaggatctggaagggtggatgcatcatccgtgctatgtttctggaccggattaagaaggcttatgacaggaacccaaacctctcaaacctacttattgacccagaattttcaaaggagatgattgagcgtcaatctgcttggcgtagggttgtctgccttgctatcggtgctggtatcagcacccctggtatgtcatcaagtcttgcttattttgattcatataggagggaaaggttgcctgctaatttggtgcaggctcaaagagattattttggagcccatacctatgagagaattgatattcctggtgctttccataccgagtggttcaaactcgctaaatccaagatctaaggcggagattgatttgtggtcactctcttaattatttactctaataatcagcttgtggctgccacatttgagttatgcattttattcaatgatttttcctcgtgccg

SEQ ID NO: 376 - protein, 483 aa, Spinacia oleracea
MAPPTRIGLAGLAVMGQNLALNIAEKGFPISVYNRTTSKVDETVERAKQEGNLPLYGFHDPESFVNSIQKPRVIIMLVKAGAPVDATIKTLSAYLEKGDCIIDGGNEWYENTERREKAMEEKGLLYLGMGVSGGEEGARNGPSMMPGGSFDAYKNIEDILTKVAAQVDSGPCVTYIGKGGSGNFVKMIHNGIEYGDMQLIAEAYDVLKSVGKLSNEELKEVFAEWNRGELLSFLIEITADIFGIKDDKGEGYLVDKVLDKTGMKGTGKWTVQQAAELSVAAPTIASSLDSRFLSGLKDERVEAAKVFKAGGVEDTLSDQVVDKKKLIDDVRQALYAAKICSYAQGMNLIRAKSVEKEWDLKLGELARIWKGGCIIRAMFLDRIKKAYDRNPNLSNLLIDPEFSKEMIERQSAWRRVVCLAIGAGISTPGMSSSLAYFDSYRRERLPANLVQAQRDYFGAHTYERIDIPGAFHTEWFKLAKSKI

SEQ ID NO: 377 - DNA, 1836 bp, Solanum tuberosum
ccccaccaaacatttctcctttttcactatatattcatcttcttcactccattgtcaagaatctcttcctttttctcctaaaattcactttttcttcattcaccatggaaggcgcagcaactgctcaagctttatctcgtattgggttagctggtcttgctgttatgggtcagaatttagccttaaacatagctgaaaaagggtttcctatatctgtttacaatagaaccacttcgaaagtagatgaaaccctagatcgtgctcagaatgaaggacaacttccgttgattggacagtacaatcctcgtgattttgtgttgtcaattcaacgacccagatctgttatcattcttgttaaagctgggtcacctgttgatcaaacgattgctgcgctttctgagtatatggagcctggggatacgattattgatgggggtaatgagtggtatgagaatactgaaaggaggattgatgaggcgtcgtcgaaggggcttttgtatttgggtatgggtgtttctggtggtgaagaaggggcgaggaatgggccttcgcttatgcctggtgggtcttatggggcttatacgaatattagagatattcttgagaaggttgcagctcaagttgaggatgggccgtgtgttacttatattggtgaaggtgggtcggggaattttgtgaaaatggtgcataatggaattgaatatggtgatatgcagttgatttcggaagcttatgatgtgttgaagaatgcaggtgggttgagtaattctgaattggctgatatttttgctgaatggaaccgtggggaattggagagttttttggttgaaattacagcggatatattcaatgtgaaggatgaattaactggaaatggggagttagtggataagattttggataagacaggaatgaagggaacggggaaatggactgtgcagcaggcggcggagctgtctattgcagctccgacgattgctgcttcgttagacagtaggtacatgagtggattgaaggatgagagggaagaagcctcagaaattttcaggaaggaagggttaaaggaggaaataagttctgatattaatggtagcagtcttgataagaagagattgattgatgatgtgaggcaggcattgtatgcgtcgaaaatctgtagttatgctcaggggatgaatttgctaagggcaaagagctctgagaaagggtggaatttgaatttgggagagttggcaaggatttggaaaggtggttgtattatcagggcagtgtttttggatcgtattaagaaggcgtatcagaggaatcctaatttggctaacttgatggttgacccggagtttgcaagggagatggtgcagaggcaagcagcttggaggagagtggtgggacttgctgttcagaagggaattagtgttcctggaatgtctgctagtcttcagtatttcgacacctacaggcgttctaggcttcccgcgaaccttgtgcaggctcagagggactatttcggggcacatacttatgagagagttgacaagtcaggagcataccataccgagtgggcaaaacttgctaggaaagcccgagtgtaatgctgctgcagctattgcggattatgatcaaaatctctggtattagttgcgctttgtcaactgtttgattttaaaattgtgcaattcaggcatttaaaattccaatgtatcttgttgagagtttatatttgctaggcataagaaagattggtaagctttttcatttagtcttgcaggttcataatgtgtatgccttttaaccattctaggggccttgggtatttaaaatgaactctttcattga

SEQ ID NO: 378 - protein, 495 aa, Solanum tuberosum
MEGAATAQALSRIGLAGLAVMGQNLALNIAEKGFPISVYNRTTSKVDETLDRAQNEGQLPLIGQYNPRDFVLSIQRPRSVIILVKAGSPVDQTIAALSEYMEPGDTIIDGGNEWYENTERRIDEASSKGLLYLGMGVSGGEEGARNGPSLMPGGSYGAYTNIRDILEKVAAQVEDGPCVTYIGEGGSGNFVKMVHNGIEYGDMQLISEAYDVLKNAGGLSNSELADIFAEWNRGELESFLVEITADIFNVKDELTGNGELVDKILDKTGMKGTGKWTVQQAAELSIAAPTIAASLDSRYMSGLKDEREEASEIFRKEGLKEEISSDINGSSLDKKRLIDDVRQALYASKICSYAQGMNLLRAKSSEKGWNLNLGELARIWKGGCIIRAVFLDRIKKAYQRNPNLANLMVDPEFAREMVQRQAAWRRVVGLAVQKGISVPGMSASLQYFDTYRRSRLPANLVQAQRDYFGAHTYERVDKSGAYHTEWAKLARKARV

SEQ ID NO: 379 - DNA, 1473 bp, Thalassiosira pseudonana
atgtccaacgacgtcggtctatacggtctcgccgtaatgggtcaaaactttgccctaaacatggccagcaaaggattcaaggtctgcgtgggcaaccgctcaccctccaaggtggaactcaccgtcaaccgcgccaaagaggagggcaacttgcccttggtggggagttcggatcccgaggacttttgcaaacagctgtccaaacctcgcaagatcatcatcttggtgatggctgggaagccagtggatgatacgatcgctacgctctcgcagtacttggaggagggcgatgtgattgtcgatggagggaacgagtggtttcagaacacgcttcgtaggtcaaaggagctggagcccaagggaattcactttgtgggtatgggaatctcgggaggggaggagggggctaggaacggcccatctctcatgccgggtggccctcgagctgcgtacgatttgattgagccaatcattaccaagtgtgctgctcaagcgaacgacggtccttgcactggttatgttggccctgtgggagctggaaactacgtgaagatgattcacaatggtatcgagtatggtgatatgcagttgattgctgagatttacgacatcatgcgcaatgtgctcaagatgtcaaacgaggagatggctgcagcgtttgctgattggaacactggcgagttggagagctatttgattgaaatcacctccaagattctcaacaagaaggatgatgtgactggggaaggatatgtcgtggattacgtcttggataagacgggtatgaagggtacgggaaggtggacgatccaggaggctgctgaaagatctgtagccgcacctacgatggcggcgtcgctcgatgctcgttacatctctgctcgtaaagacgaacgtgtcaaagcgtctcacatcctcaaaggtcctgaaatgacttcggccgagatccctgtgcacaaggggcagatgttggatgatctcaaagcggctctctatgcagccaaagtctgttcttatgctcagggactcggcatcatcaagtcctgctcagatgatatgagttgggatatcaatctttcggactgtgctcgtatgtggaaaggagggtgcattattcgtgcagcactgcttcaaaagattcaggatgcattggcaagggataagaatctgccaaacctcatccttgatccagtcattgcaggagagttgaacgaacgcacggctgcatggcgtagagttattgtggttgccattggatatggtgtttcaactcctgcattggctggttccttgaactactttgattcttaccgaagagagtctcttcctgctaatttaacgcagtcgcagagggacttctttggagggcacacgtatgagagaacggatagggatggtgtgtttcacacggcttggacggatgctcacaaaagtatcggtgatatctcagaaagaaaggctggtgaggtgtaa

SEQ ID NO: 380 - protein, 490 aa, Thalassiosira pseudonana
MSNDVGLYGLAVMGQNFALNMASKGFKVCVGNRSPSKVELTVNRAKEEGNLPLVGSSDPEDFCKQLSKPRKIIILVMAGKPVDDTIATLSQYLEEGDVIVDGGNEWFQNTLRRSKELEPKGIHFVGMGISGGEEGARNGPSLMPGGPRAAYDLIEPIITKCAAQANDGPCTGYVGPVGAGNYVKMIHNGIEYGDMQLIAEIYDIMRNVLKMSNEEMAAAFADWNTGELESYLIEITSKILNKKDDVTGEGYVVDYVLDKTGMKGTGRWTIQEAAERSVAAPTMAASLDARYISARKDERVKASHILKGPEMTSAEIPVHKGQMLDDLKAALYAAKVCSYAQGLGIIKSCSDDMSWDINLSDCARMWKGGCIIRAALLQKIQDALARDKNLPNLILDPVIAGELNERTAAWRRVIVVAIGYGVSTPALAGSLNYFDSYRRESLPANLTQSQRDFFGGHTYERTDRDGVFHTAWTDAHKSIGDISERKAGEV

SEQ ID NO: 381 - DNA, 1762 bp, Volvox carteri
aggtcttgctcgctagctttctgctcttcaatcgctgtgattggtcacgaaaacccttaagatgaacgctaacatcctcaagagcagcaagcttcagcaaacaggtggtcgtatccgggaagttcctcttacaaacacggcgttccgaagtgtggcgccgttccacgtcccttggaccgccgtccctgccgtcctgctgctaccgagaccagcccccttcgtgcgtcgtgtggtccctcatgccgcatctactgcggaggccccgcgcgccagcgacaaaagttccccaatggcggtgtccgagatcggtctcgtcggtctggctgtaatgggccagaacatggccctcaacgttgccgagaaaggcttcccgatttcggtgtacaatcgcagttatgacaaaaccgaggccgctgtgaagcgtgcgcaaaaagagggcctcggcgacaaactgcgtggctatgagtcagtgaaggatttcgtggcgagtctgcagaagccaaggcgtgtcattatccttgtcaaggccggcgcaccggtcgaccagacaatcgatgcgctctgcgagtacatggagccgggtgatattattatcgatggtggcaatgaatggtacgaaaatacggagaagcgcgtggccaaggtggcgtcgaagggtattctgtacatgggcatgggcgtctctggcggcgaggagggcgctcgccggggcccctccatgatgcccgggggtagtcccgaggcgtacacccacatcaagtcaatcgtggagaaggtggcggcacaggttgacgacggcccctgcgttatgtacattggcggcggcggtgcgggtaacttcgttaagatggttcacaacggtattgagtacggcgatatgcagctcatcagcgaggcgtacgacgtgttgaaaacacttggtggtctcgataatgaggagctggcggcggtgttcaaggaatggaaccagggtgagctcaagtccttccttgtggagatcagcgccatcattatgaacaagccggacgaccaggcccccggctacctggtggacaagattgtggaccagacgggatccaagggcacgggcaagtggaccgtacaacaggcagctgagctggcagtggcagcgcccaccatggcatcagctctggacgcgcgctacctcagtgcgctgaaggccgagcgcgtggcggcatccaaggtgttcgcctcgtgcgcccagccgggtgctgtgccccgagtggataaggcccagcttgtggcggacgtgcgggcggcgctgtatgctagcaagatttgctcgtacgcccagggcatgaacatcatcaaggccaagtccgtggagaagaactggaacatcgacctggggggtctggcaaggatctggaaaggcggctgcatcattcgcgcccagttcctggaccgcatccgtcaggcctacgagcgcaactcggagctgccctcgctgctggtggaccccgagttcgctaaggagctggcggccgcggagggagcgtggaggcgggtggcggcgctggccgtcacacacggtgtgcccatcccgtcaatgacgtcatccctctcgtactttgacacgtaccggagggagaagctgcctgccaacctggttcaggctcagcgagacttcttcggctcgcacacctaccagcgcttcgacaaggagggctggtaccacacggtctgggacgagacgtttggctcggcggactccatcaccaccagcggctacgtcgtgtga

SEQ ID NO: 382 - protein, 566 aa, Volvox carteri
MNANILKSSKLQQTGGRIREVPLTNTAFRSVAPFHVPWTAVPAVLLLPRPAPFVRRVVPHAASTAEAPRASDKSSPMAVSEIGLVGLAVMGQNMALNVAEKGFPISVYNRSYDKTEAAVKRAQKEGLGDKLRGYESVKDFVASLQKPRRVIILVKAGAPVDQTIDALCEYMEPGDIIIDGGNEWYENTEKRVAKVASKGILYMGMGVSGGEEGARRGPSMMPGGSPEAYTHIKSIVEKVAAQVDDGPCVMYIGGGGAGNFVKMVHNGIEYGDMQLISEAYDVLKTLGGLDNEELAAVFKEWNQGELKSFLVEISAIIMNKPDDQAPGYLVDKIVDQTGSKGTGKWTVQQAAELAVAAPTMASALDARYLSALKAERVAASKVFASCAQPGAVPRVDKAQLVADVRAALYASKICSYAQGMNIIKAKSVEKNWNIDLGGLARIWKGGCIIRAQFLDRIRQAYERNSELPSLLVDPEFAKELAAAEGAWRRVAALAVTHGVPIPSMTSSLSYFDTYRREKLPANLVQAQRDFFGSHTYQRFDKEGWYHTVWDETFGSADSITTSGYVV

SEQ ID NO: 383 - DNA, 2092 bp, Vitis vinifera
gccaactttgacccgccttgtgtgcagccttagaaatacataggggtgagcctctcaccctttttgaaccaaaccgttggtgttcttcaaaacccagatctccattttttctgggtctgtctcactttcaagctatcgtcatttgttcgcactttcagaggaaaaagtaatggctcctgtatcaagaattggcctttctggccttgcagtcatgggtcaaaatcttgccctcaacattgctgagaaaggattcccaatttctgtttacaaccgaaccacctcaaaagtcgatgaaaccgttgaacgagccaaacaggaaggaaaccttcccttatatggcttccatgatcctgaatcctttgttaattcaatccaaaagccccgtgtcataatcatgcttgttaaggctggggctccagttgaccagaccatcaaaaccctgtccggttacttggagaaaggagactgtatcattgatggtggcaatgagtggtatgagaacacggagaggagagagaaagccatggctgaactgggtctgctctatcttggcatgggagtttcaggtggtgaagagggtgctcgtcatgggccatctttgatgcctggaggttcatttgaggcttacaagtacatagaagatatccttcttaaagtggctgctcaagttcctgatagtggcccctgtgtgacttacattggcaaagggggttctggaaatttcgttaagatggttcacaatggtattgaatatggtgatatgcagctgattgcagaggcctatgatgtgcttaaatcagttggtaagctctccaatgaggaattgcgtaatgttttctcggagtggaacaagggggagcttttgagcttcttgattgagattactgcagatatcttcagtattaaggatgataagggagacggatttttggtagacaaggttttggacaaaactggcatgaaagggactggtaaatggacagttcagcaagctgctgacctatcagttgcagccccaactatagcatcctctttggatgcaaggttcctcagtgggctgaaggaagagcgtgttgaagctgccaaagttttcaaatcaagtggttttgaaaatgtcttgtctgaccagactgtggacaagaagaagttgatagatgatgtgaggcaggcactttatgcatccaaaatttgtagttatgcgcaaggaatgaatcttatccgggcaaagagcattgagaagggatgggatttgaaactgggtgagcttgccaggatttggaagggaggttgcattattcgtgcaatatttttggaccgtatcaagaaggcctatgataggaatgcagatcttgctaaccttcttgtggatccagagtttgcaaaggagatagttgagcgacagtctgcctggcgaagggttgtttgccttgccatcaactcaggcattagcactccgggtatgtcttctagtcttgcttactttgattcctacaggagggacaggctgcctgctaatttggtccaagctcaaagagattattttggagctcatacctatgagaggattgatacaacaggatctttccataccgaatggttcaagattgctcagcaatctaagatttgatgtgagcttcctgttggggttcccctacctaattgagcaattatcattaaacctaataatatggaagaattaggacagtttgctctgctaccatgcagtattagcggttctctagtattagttctattgagtttgttaaactattattggcctttttttttcttttcttttttattttgtgtttgtgtggagatttattgctggtctagcaggccgtgtcattctacattggaggatccactccttaataatcttattcccttataaaaataagaacatgtatgtttcccatcccagggaagataaatactgttccatgtggtgcttcttgaaggatgaattactagactagcattttcattttcctagttttggcactcctttctttgaattgtattttgtcctgcagtttcaatgcctaatggtcatcaataatggtaattctgtgttctgttttaaaaaaaa

SEQ ID NO: 384 - protein, 485 aa, Vitis vinifera
MAPVSRIGLSGLAVMGQNLALNIAEKGFPISVYNRTTSKVDETVERAKQEGNLPLYGFHDPESFVNSIQKPRVIIMLVKAGAPVDQTIKTLSGYLEKGDCIIDGGNEWYENTERREKAMAELGLLYLGMGVSGGEEGARHGPSLMPGGSFEAYKYIEDILLKVAAQVPDSGPCVTYIGKGGSGNFVKMVHNGIEYGDMQLIAEAYDVLKSVGKLSNEELRNVFSEWNKGELLSFLIEITADIFSIKDDKGDGFLVDKVLDKTGMKGTGKWTVQQAADLSVAAPTIASSLDARFLSGLKEERVEAAKVFKSSGFENVLSDQTVDKKKLIDDVRQALYASKICSYAQGMNLIRAKSIEKGWDLKLGELARIWKGGCIIRAIFLDRIKKAYDRNADLANLLVDPEFAKEIVERQSAWRRVVCLAINSGISTPGMSSSLAYFDSYRRDRLPANLVQAQRDYFGAHTYERIDTTGSFHTEWFKIAQQSKI

SEQ ID NO: 385 - DNA, 1943 bp, Zea mays
gtgcagccctgcagacttgggatttggccattgggaaggggcaggtagtaacgtaggctggcgctgcagatcaaaaggctctcgcctcggcttggcagtcggcactccctctccaccgcgctgcaggggcgacgcaaggccgagcgctcctcgatccagatccaaggtaggagatggctctcacgagaattggcctcgccggcctcgcggtcatgggacagaaccttgccctcaacatcgcggagaaagggttccccatctcggtctacaacaggacaacctccaaggttgatgagaccgtgcagcgtgccaaggtcgaaggaaacctcccagtgtttggtttccacgaccccgcgtccttcgtgagctccatccagaagccccgtgtcgtcatcatgctcgtcaaggctggggcgccggtggaccagaccattgccacgctcgcggcgcaccttgatcagggggactgtatcgtcgatggtggcaacgagtggtacgagaacacggagaggagggagaaggcgatggaggagcgcgggctcctatatcttggcatgggcgtctccggaggagaggagggtgcccgcaatggcccgtccttgatgcccgggggctccttcgaggcatacaagtacattgaagatattcttctcaaggtggctgctcaggtacctgacagcggcccgtgcgtcacatatattggcaaaggtggatcaggcaacttcgtcaagatggttcacaatggaattgaatatggtgacatgcaacttatcgccgaggcttatgatgttctcaagtcggtgggtaagctcacaaacagcgagctgcatcaggtgttctctgagtggaacaagggtgagctcctcagtttcttgattgagatcacggccgacatctttggtatcaaggatgacaagggtgaaggctacctggtcgacaaggtcctggacaagaccgggatgaagggaactgggaaatggacagtccagcaggctgctgagctttctgtagctgctcctacaatcgaggcgtccttggactccaggttcctcagcggtctgaaggacgagcgcgttgaggcttccaaaatcttccaaggtgactactccactggcctaccggtggacaaggcacagctgatcgaggacgtgaggcaagctctatatgcctccaagatctgcagttacgcgcagggcatgaacatcatcaaggccaagagctcagagaaaggatggggcctcaaccttggtgagctagcgaggatctggaagggagggtgcatcatccgtgccatcttcctcgaccgcatcaagaaggcgtacgataggaaccctaaccttgccaacctcctcgttgaccccgagttcgcccaggagatcatagacaggcaagctgcctggcgcagggttgtctgccttgccatcaacaatggcgttagcaccccaggcatgtctgcaagtctggcctacttcgactcgtaccgcagggataggcttcccgccaacctggtgcaggctcagagagactacttcggcgctcacacgtacgagagggttgacatgcctggttctttccacaccgagtggttcaagattgcgcgcaactccaagatctgaacatggcctcgtgtttgcatatgccagtatgccaccgtgtcgagtaatcaatcatattactgcttgcagggaggaactgtgtttgatttttattttccatgcgcaatgcttaatttaggtcaggaagtccaaagtctctcccattgttttcctgtaagagctaagcagtaccagatggagaaccttatatttgctggaacatgaataaaagcatttgacatgcttgtgtttagttttctgtcggccatgcattatattttcctttccccttgacagaaattttttcctgtacggaagtgtgggctattagtattaatttttccagtc

SEQ ID NO: 386 - protein, 480 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERVDMPGSFHTEWFKIARNSKI

SEQ ID NO: 387 - protein, 541 aa, Artificial sequence
  Consensus
  misc_feature (5)..(5): Xaa can be any naturally occurring amino acid
  misc_feature (26)..(27): Xaa can be any naturally occurring amino acid
  misc_feature (31)..(33): Xaa can be any naturally occurring amino acid
  misc_feature (61)..(61): Xaa can be any naturally occurring amino acid
  misc_feature (65)..(65): Xaa can be any naturally occurring amino acid
  misc_feature (69)..(69): Xaa can be any naturally occurring amino acid
  misc_feature (86)..(86): Xaa can be any naturally occurring amino acid
  misc_feature (102)..(102): Xaa can be any naturally occurring amino acid
  misc_feature (130)..(130): Xaa can be any naturally occurring amino acid
  misc_feature (135)..(136): Xaa can be any naturally occurring amino acid
  misc_feature (150)..(150): Xaa can be any naturally occurring amino acid
  misc_feature (175)..(201): Xaa can be any naturally occurring amino acid
  misc_feature (226)..(226): Xaa can be any naturally occurring amino acid
  misc_feature (254)..(285): Xaa can be any naturally occurring amino acid
  misc_feature (320)..(321): Xaa can be any naturally occurring amino acid
  misc_feature (383)..(405): Xaa can be any naturally occurring amino acid
  misc_feature (427)..(427): Xaa can be any naturally occurring amino acid
  misc_feature (438)..(449): Xaa can be any naturally occurring amino acid
  misc_feature (468)..(468): Xaa can be any naturally occurring amino acid
  misc_feature (475)..(475): Xaa can be any naturally occurring amino acid
  misc_feature (526)..(526): Xaa can be any naturally occurring amino acid
  misc_feature (532)..(533): Xaa can be any naturally occurring amino acid
AATIXSVKARQIFDSRGNPTVEVDVXXSDGXXXRAAVPSGASTGIYEALELRDGGSDYLGXKGVXKAVXNVNSIIGPALIGKDPTXQTEIDNFMVQQLDGTXNEWGWCKQKLGANAILAVSLAVCKAGAXVKKIXXPLYKHIANLAGNKXLVLPVPAFNVINGGSHAGNKLAMQXXXXXXXXXXXXXXXXXXXXXXXXXXXEFMILPVGASSFKEAMKMGVEVYHXLKSVIKKKYGQDATNVGDEGGFAPNIQXXXXXXXXXXXXXXXXXXXXXXXXXXXXXXXXENKEGLELLKTAIEKAGYTGKVVIGMDVAASEFYXXKDKTYDLNFKEENNDGSQKISGDSLKDLYKSFVSEYPIVSIEDPFDQDDWEHYAKLTAEIGXXXXXXXXXXXXXXXXXXXXXXXQVQIVGDDLLVTNPKRVAKAIXEKSCNALLLKXXXXXXXXXXXXVNQIGSVTESIEAVKMSKXAGWGVMXSHRSGETEDTFIADLAVGLATGQIKTGAPCRSERLAKYNQLLRIEEELGAXAVYAGXXFRAPVEPY

SEQ ID NO: 388 - protein, 799 aa, Arabidopsis thaliana
MVDHHHHHHHQHRPNRLSVPQPTIGRTYPSFPYTPTPTPSKTRLSSSSSYRSIHGSKSSLSFLFLILFSLRSLYSLLPFLRSSPSFSLFPFSFLVSLLSFLFSLSFTIISSFSPSKKDPFLLRLQNRSFSSISSLSSSQIKLLLAKSFLLAFVFLLRFQALRYCGAAAMILAELSGTVSARVLFSDTGGIGVRSSKVRGFCVLFAGLLLLSISWDRVDCFPFSSSVESWBGFWIYPKENCLRIWPLLLPFLSGFLGCYEKVSVNWNEIKQLDQKRVRLLSLFLTTVLLFPLAIWSFFFSGSGDDSVSFGNLGWPLANTVVFGVLLSENYNDDKFSSSKKKDSEREFLVTFLCTIVLELFYFPELSLWGLLLCGLLLYIAVRELESVYSDYQEIGMESPESFSTMFMKPIRHILSEKKSRKIALFLLINTAYMVVEFVAGFMSNSLGLISDACHMLFDCAALAIGLYASYISRLPANHQYNYGRGRFEVLSGYVNAVFLVLVGALIVLESIERILDPQEISTNSLLVVSVGGLLVNIVGLIFFHEEHHHAHGGSGCTHSHSHQSHSHKNEEHHQHSDSHKHEEHHQHSDSHKHEEHHEHDHHHHSHSHKHEECNHNHDHEHQSHSHNHEECNHNHDHHSDHQPEKSEKKEHRHIDHNMEGIFLHVLADTMGSVGVVISTLLIKYKGWLVADPASSIFISILIIASVIPLLRNSAEILLQRVPRAHRQDLKEAMRNILKTKGVCSIQRLHVWSFTNSDVVATLHLLVSADSDKTDTKLQVSRLLEDAGVKDWTLQVESVNS

SEQ ID NO: 389 - protein, 395 aa, Phaeodactylum tricornutum
MHDHDHEHNCSSHHEKGLPTPSPTLDGVSDSGSHNAAQQQRLQVLRRLQTATVLCLCFMTIEVIGGFWAGSLAVLSDAAHLLADTASFAIAIVANYLARMPSTVTHTYGLQRTESLAALFSMVSLAIVCVGLASEASRRLYHIVMQDDAAEELLNVDGRLMSGIATIGVCVNIVLALVLGEHHVHLPSYGDSHGHDHHHDHVHPATESSALLPKSTNGDVEHCVIHNDEAVPDKARNVNLHAAYLHVLGDLAQSVAVLIAGIVIWLKPSWAIVDPICTLGFCGLVFYSTLGVLRSSIAVLLEEVPPHVSWQDVYDDLSELESLTKVHDLHIWCISDGVTVVSLHASAVDGHVDQALRDVNRVCQKHKLQHITAQLQTASVEECITCTQSNLNCKS

SEQ ID NO: 390 - protein, 414 aa, Arabidopsis thaliana
LNCLCSCLHISNHKIKLKISEEDSSGIHIRFASPSDSQLMELEQICILKPDDEEEMESPSPSKTEENLGVVPLSCAFTRQEHCVSETKEREESTRRLSSLIFLYLIVMSVQIVGGFKANSLAVMTDAAHLLSDVAGLCVSLLAIKVSSWEANPRNSFGFKRLEVLAAFLSVQLIWLVSGVIIHEAIQRLLSRSREVNGEIMFGISAFGFFMNLVMVLWLGHNHSHHHHDHHHHHHNHKHQHQHHHKEVVAEEEEEEMNPLKGEKSSSKEMNINIQGAYLHAMADMIQSLGVMIGGGIIWVKPKWVLVDLICTLVFSAFALAATLPILKNIFGILMERVPRDMDIEKLERGLKRIDGVKIVYDLHVWEITVGRIVLSCHILPEPGASPKEIITGVRNFCRKSYGIYHATVQVESE

SEQ ID NO: 391 - protein, 382 aa, Vitis vinifera
MEDNEVSIRTEHQQEIEMSKASKENVLTMPSQLSCCHICAFSQHEISRSESEQRSKSSRKLCGLIIFYLIFMAVEIVGGIKSNSLAVLTDAAHLLSDVFGFSISLFAVWASGWRATSQQSFGFNRVEVLGALFSVQLIWLIAGILIYEAVNRILHQHAKVNGKLMFAIAAFGFISNLIMVTWLGHDHTHHDCGHKDHDHDHHDYHDHHHHHHHESDKPCSMDEEESTKLVSSSPEKTKILNINLQGAYLHVMADLIQSVGVMVAGGIIWAKPEWLMVDLVCTLCFSVLVLTTTLTMLRNIFSILMERAPIEIDIAGLENGLKSIKGVQDVHDLHVWAITVGKVVMSCHVIAEPGATSSEILGDIRDYCEKTYRILHVTVQVE

SEQ ID NO: 392 - protein, 396 aa, Physcomitrella patens
MKCANNHTCSLESNNTIEQDKIERENASKKLKKAMIFCIFFMCVEVVGGMYANSLAILTDAAHLLSDIAGFAISLFAIWASSWESTAIQSYGFFRLEILGALVSIQFIWLVTGMLLYEAFERLYDSNKDIVNGTVMFGIAILGLFVNIAMIVLLGHENYSFNIGNHEHHHNHGHDSHENGSSNSYKNHKHDNFDESFDLHGDKDHEHDTSHKNVNPNSTSSKTHEENNFNDEKHDVSMLSKTTATVQHGHNNLNLQGAYLHVLGDAIQSIGVIIGAAAIWYNPKWKIIDVICTILFSVLVLGTTIQMLKDVLHILMESTPHEINAQEVQYGLNELPNVVAIHELHIWALTIGKTLLTCHIQVSPNANYDEVLQNVVDYLEIKFKITHTTIQIESRI

SEQ ID NO: 393 - protein, 394 aa, Physcomitrella patens
MKCAATRCGLESVGGMEQDEVERRASSKKLSRAVMICLFFMVVEIVGGLYANSLAILTDAAHLLTDVAGFALSLFAIWASGWEATPLQTFGFSRLEILGALGSILFIWLLTGILVFEAIKRLLTEVAPIDGRLMFCIASVGLLVNLCMMVLLGHEHGHAHGHGHSHGHGHGHGHEHSHEDDHGNGHSHDHGHGHSHDDEHVHSHGSESQGTHDGQHGHSSHKHNTSQPLLKKSHSVSLCRDLSKKKPERNINVQGAYLHVLGDLLQSVGVMIGGAVIWYQPRWKVIDPVCTLIFSVLVLCTTLSMIRSIVEVLMESTPREIDAQAVERGLLGLPGVVEVHDLHIWAITVGKTLLACHIRVQPQVNTNEALQAVADYCERVFKISHVTIQVETDS

The invention claimed is:

1. A method for increasing seed yield, number of flowers, root biomass, and/or emergence vigor in a plant relative to a control plant, comprising introducing and expressing in a plant a nucleic acid encoding a methionine sulfoxide reductase (MSR) polypeptide, and evaluating the plant for a phenotype of increased seed yield, increased number of flowers, increased root biomass, and/or increased emergence vigor under non-stress conditions relative to a control plant, wherein said nucleic acid is: (a) a nucleic acid comprising the nucleotide sequence of SEQ ID NO: 1, 23, 101 or 163; (b) a nucleic acid encoding a polypeptide comprising the amino acid sequence of SEQ ID NO: 2, 24, 102 or 164; or (c) a nucleic acid encoding a polypeptide having at least 95% sequence identity to the amino acid sequence of SEQ ID NO: 2, 24, 102 or 164.

2. The method of claim 1, wherein said MSR polypeptide comprises at least one conserved protein motif selected from the group consisting of:
   (i) Motif 1 of SEQ ID NO: 173;
   (ii) Motif 2 of SEQ ID NO: 174;
   (iii) Motif 3 of SEQ ID NO: 175; and
   (iv) Motif 4 of SEQ ID NO: 176.

3. The method of claim 1, wherein said nucleic acid hybridizes to a nucleic acid comprising the nucleotide sequence of SEQ ID NO: 1, 23, 101 or 163 under stringent hybridization conditions comprising hybridization at 65° C. in 1×SSC or at 42° C. in 1×SSC and 50% formamide, followed by washing at 65° C. in 0.3×SSC.

4. The method of claim 1, wherein said plant has increased seed yield, increased number of flowers, increased root biomass, and/or increased emergence vigor under non-stress conditions relative to a control plant under conditions of drought stress, salt stress or nitrogen deficiency.

5. The method of claim 1, wherein said nucleic acid is operably linked to a constitutive promoter, a GOS2 promoter, or a GOS2 promoter from rice.

6. The method of claim 1, wherein said nucleic acid encoding an MSR polypeptide is of plant origin or obtained from a monocotyledonous plant, a plant from the genus *Oryza*, a *Oryza sativa* plant, a dicotyledonous plant, a plant from the genus *Medicago*, or a *Medicago truncatula* plant.

7. A plant or part thereof, or a seed or progeny of said plant, obtained by the method of claim 1, wherein said plant or part thereof, or said seed or progeny, comprises a recombinant nucleic acid encoding said MSR polypeptide, wherein said nucleic acid is operably linked to a GOS2 promoter, and wherein said plant or progeny has increased seed yield, increased number of flowers, increased root biomass, and/or increased emergence vigor under non-stress conditions relative to a control plant.

8. A method for making a plant having increased seed yield, increased number of flowers, increased root biomass, and/or increased emergence vigor relative to a control plant, comprising transforming into a plant a construct comprising: (i) a nucleic acid encoding an MSR polypeptide as defined in claim 1; (ii) one or more control sequences capable of driving expression of the nucleic acid of (i); and optionally (iii) a transcription termination sequence, wherein said nucleic acid of (i) is operably linked to a GOS2 promoter, and evaluating the plant for a phenotype of increased seed yield, increased number of flowers, increased root biomass, and/or increased emergence vigor relative to a control plant.

9. A plant transformed with a construct comprising: (i) a nucleic acid encoding an MSR polypeptide as defined in claim 1; (ii) one or more control sequences capable of driving expression of the nucleic acid of (i); and optionally (iii) a transcription termination sequence, wherein said nucleic acid of (i) is operably linked to a GOS2 promoter, wherein said transformed plant has increased seed yield, increased number of flowers, increased root biomass, and/or increased emergence vigor under non-stress conditions relative to a control plant, or a transformed plant part or plant cell obtained from said transformed plant.

10. A method for the production of a transgenic plant having increased seed yield, increased number of flowers, increased root biomass, and/or increased emergence vigor relative to a control plant, comprising: (i) introducing and expressing in a plant a nucleic acid encoding an MSR polypeptide; (ii) cultivating the plant under conditions promoting plant growth and development; and (iii) evaluating the plant for a phenotype of increased seed yield, increased number of flowers, increased root biomass, and/or increased emergence vigor under non-stress conditions relative to a control plant, wherein said nucleic acid is: (a) a nucleic acid comprising the nucleotide sequence of SEQ ID NO: 1, 23, 101 or 163; (b) a nucleic acid encoding a polypeptide comprising the amino acid sequence of SEQ ID NO: 2, 24, 102 or 164; or (c) a nucleic acid encoding a polypeptide having at least 95% sequence identity to the amino acid sequence of SEQ ID NO: 2, 24, 102 or 164.

11. A transgenic plant having increased seed yield, increased number of flowers, increased root biomass, and/or increased emergence vigor relative to a control plant under non-stress conditions, resulting from introducing and increasing expression of a nucleic acid encoding an MSR polypeptide, or a transgenic plant cell from said transgenic plant, wherein said nucleic acid is: (a) a nucleic acid comprising the nucleotide sequence of SEQ ID NO: 1, 23, 101 or 163; (b) a nucleic acid encoding a polypeptide comprising the amino acid sequence of SEQ ID NO: 2, 24, 102 or 164; or (c) a nucleic acid encoding a polypeptide having at least 95% sequence identity to the amino acid sequence of SEQ ID NO: 2, 24, 102 or 164; and wherein said nucleic acid is operably linked to a GOS2 promoter.

12. The plant of claim 7, or a transgenic plant cell thereof, wherein said plant is a crop plant, a monocot or a cereal, or wherein said plant is rice, maize, wheat, barley, millet, rye, triticale, *sorghum* emmer, spelt, *secale*, einkorn, teff, milo or oats.

13. An harvestable part of the plant of claim 12, wherein said harvestable part comprises a recombinant nucleic acid encoding said MSR polypeptide, wherein said nucleic acid is operably linked to a GOS2 promoter.

14. A product derived from the plant of claim 12 and/or from an harvestable part of said plant, wherein said product comprises a recombinant nucleic acid encoding said MSR polypeptide, wherein said nucleic acid is operably linked to a GOS2 promoter.

15. A method for increasing seed yield in a plant relative to a control plant, comprising transforming a nucleic acid encoding an MSR polypeptide into a plant or plant cell, and evaluating the plant for a phenotype of increased seed yield relative to a control plant, wherein said nucleic acid is: (a) a nucleic acid comprising the nucleotide sequence of SEQ ID NO: 1; (b) a nucleic acid encoding a polypeptide comprising the amino acid sequence of SEQ ID NO: 2; or (c) a nucleic acid encoding a polypeptide having at least 95% sequence identity to the amino acid sequence of SEQ ID NO: 2.

16. The transgenic plant of claim 11, wherein said MSR polypeptide comprises at least one conserved protein motif selected from the group consisting of:
(i) Motif 1 of SEQ ID NO: 173;
(ii) Motif 2 of SEQ ID NO: 174;
(iii) Motif 3 of SEQ ID NO: 175; and
(iv) Motif 4 of SEQ ID NO: 176.

17. The harvestable part of claim 13, wherein said harvestable part is shoot biomass and/or seeds.

18. The method of claim 1, wherein said nucleic acid comprises the nucleotide sequence of SEQ ID NO: 1, 23, 101 or 163, or encodes a polypeptide comprising the amino acid sequence of SEQ ID NO: 2, 24, 102 or 164.

19. The method of claim 10, wherein said nucleic acid comprises the nucleotide sequence of SEQ ID NO: 1, 23, 101 or 163, or encodes a polypeptide comprising the amino acid sequence of SEQ ID NO: 2, 24, 102 or 164.

20. The method of claim 15, wherein said nucleic acid comprises the nucleotide sequence of SEQ ID NO: 1 or encodes a polypeptide comprising the amino acid sequence of SEQ ID NO: 2.

21. The method of claim 10, wherein said plant has an enhanced yield-related trait relative to a control plant under conditions of drought stress, salt stress or nitrogen deficiency.

* * * * *